(12) United States Patent
Thomas et al.

(10) Patent No.: US 10,913,941 B2
(45) Date of Patent: *Feb. 9, 2021

(54) ENZYMES WITH RUVC DOMAINS

(71) Applicant: Metagenomi IP Technologies, LLC, Emeryville, CA (US)

(72) Inventors: Brian Thomas, Emeryville, CA (US); Christopher Brown, Emeryville, CA (US); Rose Kantor, Emeryville, CA (US); Audra Devoto, Emeryville, CA (US); Cristina Butterfield, Emeryville, CA (US); Lisa Alexander, Emeryville, CA (US); Daniela S. A. Goltsman, Emeryville, CA (US); Jason Liu, Emeryville, CA (US)

(73) Assignee: METAGENOMI IP TECHNOLOGIES, LLC, Emeryville, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 16/917,838

(22) Filed: Jun. 30, 2020

(65) Prior Publication Data

US 2020/0332274 A1 Oct. 22, 2020

Related U.S. Application Data

(63) Continuation-in-part of application No. PCT/US2020/018432, filed on Feb. 14, 2020.

(60) Provisional application No. 62/874,414, filed on Jul. 15, 2019, provisional application No. 62/805,899, filed on Feb. 14, 2019, provisional application No. 62/805,868, filed on Feb. 14, 2019, provisional application No. 62/805,878, filed on Feb. 14, 2019, provisional application No. 63/022,320, filed on May 8, 2020.

(51) Int. Cl.
*C12N 9/22* (2006.01)
*C12N 15/113* (2010.01)
*C12N 15/11* (2006.01)

(52) U.S. Cl.
CPC .............. *C12N 9/22* (2013.01); *C12N 15/11* (2013.01); *C12N 15/113* (2013.01); *C12N 2310/20* (2017.05); *C12N 2310/531* (2013.01); *C12N 2800/80* (2013.01)

(58) Field of Classification Search
CPC ...... C12N 9/22; C12N 15/11; C12N 2310/20; C12N 2800/80; C12N 2310/531
See application file for complete search history.

(56) References Cited

U.S. PATENT DOCUMENTS

| 8,889,418 | B2 | 11/2014 | Zhang et al. | |
| 10,011,849 | B1* | 7/2018 | Gill | C12N 15/85 |
| 10,392,607 | B2* | 8/2019 | Sternberg | C12N 15/11 |
| 2019/0264232 | A1* | 8/2019 | Hou | C12N 15/52 |
| 2020/0080067 | A1* | 3/2020 | Zhang | C12N 9/22 |

FOREIGN PATENT DOCUMENTS

WO WO-2020168291 A1 8/2020

OTHER PUBLICATIONS

Andronescu et al. Efficient Parameter Estimation for RNA Secondary Structure Prediction. Bioinformatics 23(13):i19-28 (2007).
Co-pending U.S. Appl. No. 16/917,837, filed on Jun. 30, 2020.
Huber et al. Orchestrating High-Throughput Genomic Analysis With Bioconductor. Nat Methods 12(2):115-21 (2015).
Jinek et al. A programmable dual-RNA-guided DNA endonuclease in adaptive bacterial immunity. Science 337(6096):816-821 (2012).
Karvelis et al. Methods for Decoding Cas9 Protospacer Adjacent Motif (PAM) Sequences: A Brief Overview. Methods 121-122:3-8 (2017).
Mali et al. RNA-guided human genome engineering via Cas9. Science 339(6121):823-826 (2013).
Schneider et al. Sequence logos: a new way to display consensus sequences. Nucleic acids research 18(20):6097-6100 (1990).
Shmakov et al. Discovery and Functional Characterization of Diverse Class 2 CRISPR-Cas Systems. Mol Cell 60(3):385-397 (2015).
Gasiunas et al. Cas9-crRNA ribonucleoprotein complex mediates specific DNA cleavage for adaptive immunity in bacteria. PNAS 109:E2579-2586 (2012).
PCT/US2020/018432 International Search Report and Written Opinion dated Jun. 30, 2020.
Shmakov et al., Diversity and evolution of class 2 CRISPR-Cas systems. Nat Rev. Microbiol. 15(3): 169-182 (2017).
U.S. Appl. No. 16/917,837 Office Action dated Aug. 26, 2020.

* cited by examiner

*Primary Examiner* — Ganapathirama Raghu
(74) *Attorney, Agent, or Firm* — Wilson Sonsini Goodrich & Rosati

(57) ABSTRACT

The present disclosure provides for endonuclease enzymes having distinguishing domain features, as well as methods of using such enzymes or variants thereof.

16 Claims, 51 Drawing Sheets

Specification includes a Sequence Listing.

Gel 4

Gel 5

Gel 6

Gel 10

Gel 11

MG2-7 Synthetic PAM

MG3-6 Native PAM

MG3-6 Synthetic PAM

MG3-7 Native PAM

ENZYMES WITH RUVC DOMAINS

CROSS-REFERENCE

This application is a continuation in part of International Application No. PCT/US20/18432, filed on Feb. 14, 2020, entitled "ENZYMES WITH RUVC DOMAINS", which application claims the benefit of U.S. Provisional Application Nos. 62/874,414 filed on Jul. 15, 2019, 62/805,899 filed on Feb. 14, 2019, 62/805,868 filed on Feb. 14, 2019, and 62/805,878 filed on Feb. 14, 2019. This application also claims the benefit of U.S. Provisional Application No. 63/022,320, filed on May 8, 2020, entitled "ENZYMES WITH RUVC DOMAINS". Both of these applications are incorporated by reference herein in their entireties.

BACKGROUND

Cas enzymes along with their associated Clustered Regularly Interspaced Short Palindromic Repeats (CRISPR) guide ribonucleic acids (RNAs) appear to be a pervasive (~45% of bacteria, ~84% of archaea) component of prokaryotic immune systems, serving to protect such microorganisms against non-self nucleic acids, such as infectious viruses and plasmids by CRISPR-RNA guided nucleic acid cleavage. While the deoxyribonucleic acid (DNA) elements encoding CRISPR RNA elements may be relatively conserved in structure and length, their CRISPR-associated (Cas) proteins are highly diverse, containing a wide variety of nucleic acid-interacting domains. While CRISPR DNA elements have been observed as early as 1987, the programmable endonuclease cleavage ability of CRISPR/Cas complexes has only been recognized relatively recently, leading to the use of recombinant CRISPR/Cas systems in diverse DNA manipulation and gene editing applications.

SEQUENCE LISTING

The instant application contains a Sequence Listing which has been submitted electronically in ASCII format and is hereby incorporated by reference in its entirety. Said ASCII copy, created on Jun. 30, 2020, is named 55921_702_302_SL.txt and is 23,363,499 bytes in size.

SUMMARY

In some aspects, the present disclosure provides for an engineered nuclease system, comprising: (a) an endonuclease comprising a RuvC_III domain and an HNH domain, wherein the endonuclease is derived from an uncultivated microorganism, wherein the endonuclease is a class 2, type II Cas endonuclease; and (b) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease. In some embodiments, the RuvC_III domain comprises a sequence with at least 70%, at least 75%, at least 80% or at least 90% sequence identity to any one of SEQ ID NOs: 1827-3637.

In some aspects, the present disclosure provides for an engineered nuclease system comprising: (a) an endonuclease comprising a RuvC_III domain having at least 75% sequence identity to any one of SEQ ID NOs: 1827-3637; and (b) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease.

In some aspects, the present disclosure provides for an engineered nuclease system comprising: (a) an endonuclease configured to bind to a protospacer adjacent motif (PAM) sequence comprising SEQ ID NOs: 5512-5537, wherein the endonuclease is a class 2, type II Cas endonuclease; and (b) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease.

In some embodiments, the endonuclease is derived from an uncultivated microorganism. In some embodiments, the endonuclease has not been engineered to bind to a different PAM sequence. In some embodiments, the endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, the endonuclease has less than 80% identity to a Cas9 endonuclease. In some embodiments, the endonuclease further comprises an HNH domain. In some embodiments, the tracr ribonucleic acid sequence comprises a sequence with at least 80% sequence identity to about 60 to 90 consecutive nucleotides selected from any one of SEQ ID NOs: 5476-5511 and SEQ ID NO: 5538.

In some aspects, the present disclosure provides for an engineered nuclease system comprising, (a) an engineered guide ribonucleic acid structure comprising: (i) a guide ribonucleic acid sequence configured to hybridize to a target deoxyribonucleic acid sequence; and (ii) a tracr ribonucleic acid sequence configured to bind to an endonuclease, wherein the tracr ribonucleic acid sequence comprises a sequence with at least 80% sequence identity to about 60 to 90 consecutive nucleotides selected from any one of SEQ ID NOs: 5476-5511 and SEQ ID NO: 5538; and (b) a class 2, type II Cas endonuclease configured to bind to the engineered guide ribonucleic acid. In some embodiments, the endonuclease is configured to bind to a protospacer adjacent motif (PAM) sequence selected from the group comprising SEQ ID NOs: 5512-5537.

In some embodiments, the engineered guide ribonucleic acid structure comprises at least two ribonucleic acid polynucleotides. In some embodiments, the engineered guide ribonucleic acid structure comprises one ribonucleic acid polynucleotide comprising the guide ribonucleic acid sequence and the tracr ribonucleic acid sequence.

In some embodiments, the guide ribonucleic acid sequence is complementary to a prokaryotic, bacterial, archaeal, eukaryotic, fungal, plant, mammalian, or human genomic sequence. In some embodiments, the guide ribonucleic acid sequence is 15-24 nucleotides in length. In some embodiments, the endonuclease comprises one or more nuclear localization sequences (NLSs) proximal to an N- or C-terminus of the endonuclease. In some embodiments, the NLS comprises a sequence selected from SEQ ID NOs: 5597-5612.

In some embodiments, the engineered nuclease system further comprises a single- or double-stranded DNA repair template comprising from 5' to 3': a first homology arm comprising a sequence of at least 20 nucleotides 5' to the target deoxyribonucleic acid sequence, a synthetic DNA sequence of at least 10 nucleotides, and a second homology arm comprising a sequence of at least 20 nucleotides 3' to the target sequence. In some embodiments, the first or second homology arm comprises a sequence of at least 40, 80, 120, 150, 200, 300, 500, or 1,000 nucleotides.

In some embodiments, the system further comprises a source of $Mg^{2+}$.

In some embodiments, the endonuclease and the tracr ribonucleic acid sequence are derived from distinct bacterial species within a same phylum. In some embodiments, the endonuclease is derived from a bacterium belonging to a genus Dermabacter. In some embodiments, the endonuclease is derived from a bacterium belonging to Phylum Verrucomicrobia, Phylum Candidatus Peregrinibacteria, or Phylum Candidatus Melainabacteria. In some embodiments, the endonuclease is derived from a bacterium comprising a 16S rRNA gene having at least 90% identity to any one of SEQ ID NOs: 5592-5595.

In some embodiments, the HNH domain comprises a sequence with at least 70% or at least 80% identity to any one of SEQ ID NOs: 5638-5460. In some embodiments, the endonuclease comprises SEQ ID NOs: 1-1826 or a variant thereof having at least 55% identity thereto. In some embodiments, the endonuclease comprises a sequence at least 70%, 80%, or 90% identical to a sequence selected from the group consisting of SEQ ID NOs: 1827-1830 or SEQ ID NOs: 1827-2140.

In some embodiments, the endonuclease comprises a sequence at least 70%, 80%, or 90% identical to a sequence selected from the group consisting of SEQ ID NOs: 3638-3641 or SEQ ID NOs: 3638-3954. In some embodiments, the endonuclease comprises at least 1, at least 2, at least 3, at least 4, or at least 5 peptide motifs selected from the group consisting of SEQ ID NOs: 5615-5632. In some embodiments, the endonuclease comprises a sequence at least 70%, 80%, or 90% identical to a sequence selected from the group consisting of SEQ ID NOs: 1-4 or SEQ ID NOs: 1-319.

In some embodiments, the guide RNA structure comprises a sequence at least 70%, 80%, or 90% identical to a sequence selected from the group consisting of SEQ ID NOs: 5461-5464, SEQ ID NOs: 5476-5479, or SEQ ID NOs: 5476-5489. In some embodiments, the guide RNA structure comprises an RNA sequence predicted to comprise a hairpin consisting of a stem and a loop, wherein the stem comprises at least 10, at least 12 or at least 14 base-paired ribonucleotides, and an asymmetric bulge within 4 base pairs of the loop.

In some embodiments, the endonuclease is configured to bind to a PAM comprising a sequence selected from the group consisting of SEQ ID NOs: 5512-5515 or SEQ ID NOs: 5527-5530.

In some embodiments: (a) the endonuclease comprises a sequence at least 70%, at least 80%, or at least 90% identical to SEQ ID NO: 1827; (b) the guide RNA structure comprises a sequence at least 70%, at least 80%, or at least 90% identical to at least one of SEQ ID NO: 5461 or SEQ ID NO: 5476; and (c) the endonuclease is configured to bind to a PAM comprising SEQ ID NO: 5512 or SEQ ID NO: 5527. In some embodiments: (a) the endonuclease comprises a sequence at least 70%, at least 80%, or at least 90% identical to SEQ ID NO: 1828; (b) the guide RNA structure comprises a sequence at least 70%, at least 80%, or at least 90% identical to at least one of SEQ ID NO: 5462 or SEQ ID NO: 5477; and (c) the endonuclease is configured to bind to a PAM comprising SEQ ID NO: 5513 or SEQ ID NO: 5528. In some embodiments: (a) the endonuclease comprises a sequence at least 70%, at least 80%, or at least 90% identical to SEQ ID NO: 1829; (b) the guide RNA structure comprises a sequence at least 70%, at least 80%, or at least 90% identical to at least one of SEQ ID NO: 5463 or SEQ ID NO: 5478; and (c) the endonuclease is configured to bind to a PAM comprising SEQ ID NO: 5514 or SEQ ID NO: 5529. In some embodiments: (a) the endonuclease comprises a sequence at least 70%, at least 80%, or at least 90% identical to SEQ ID NO: 1830; (b) the guide RNA structure comprises a sequence at least 70%, at least 80%, or at least 90% identical to at least one of SEQ ID NO: 5464 or SEQ ID NO: 5479; and (c) the endonuclease is configured to bind to a PAM comprising SEQ ID NO: 5515 or SEQ ID NO: 5530.

In some embodiments, the endonuclease comprises a sequence at least 70%, 80%, or 90% identical to a sequence selected from the group consisting of SEQ ID NOs: 2141-2142 or SEQ ID NOs: 2141-2241. In some embodiments, the endonuclease comprises a sequence at least 70%, 80%, or 90% identical to a sequence selected from the group consisting of SEQ ID NOs: 3955-3956 or SEQ ID NOs: 3955-4055. In some embodiments, the endonuclease comprises at least 1, at least 2, at least 3, at least 4, or at least 5 peptide motifs selected from the group consisting of SEQ ID NOs: 5632-5638. In some embodiments, the endonuclease comprises a sequence at least 70%, 80%, or 90% identical to a sequence selected from the group consisting of SEQ ID NOs: 320-321 or SEQ ID NOs: 320-420. In some embodiments, the guide RNA structure comprises a sequence at least 70%, 80%, or 90% identical to a sequence selected from the group consisting of SEQ ID NO: 5465, SEQ ID NOs: 5490-5491 or SEQ ID NOs: 5490-5494. In some embodiments, the guide RNA structure comprises a tracr ribonucleic acid sequence comprising a hairpin comprising at least 8, at least 10, or at least 12 base-paired ribonucleotides. In some embodiments, the endonuclease is configured to bind to a PAM comprising a sequence selected from the group consisting of SEQ ID NOs: 5516 and SEQ ID NOs: 5531. In some embodiments: (a) the endonuclease comprises a sequence at least 70%, 80%, or 90% identical to SEQ ID NO: 2141; (b) the guide RNA structure comprises a sequence at least 70%, 80%, or 90% identical to SEQ ID NO: 5490; and (c) the endonuclease is configured to binding to a PAM comprising SEQ ID NO: 5531. In some embodiments: (a) the endonuclease comprises a sequence at least 70%, 80%, or 90% identical to SEQ ID NO: 2142; (b) the guide RNA structure comprises a sequence at least 70%, 80%, or 90% identical to SEQ ID NO: 5465 or SEQ ID NO: 5491; and (c) the endonuclease is configured to binding to a PAM comprising SEQ ID NO: 5516.

In some embodiments, the endonuclease comprises a sequence at least 70%, 80%, or 90% identical to a sequence selected from the group consisting of SEQ ID NOs: 2245-2246. In some embodiments, the endonuclease comprises a sequence at least 70%, 80%, or 90% identical to a sequence selected from the group consisting of SEQ ID NOs: 4059-4060. In some embodiments, the endonuclease comprises at least 1, at least 2, at least 3, at least 4, or at least 5 peptide motifs selected from the group consisting of SEQ ID NOs: 5639-5648. In some embodiments, the endonuclease comprises a sequence at least 70%, 80%, or 90% identical to a sequence selected from the group consisting of SEQ ID NOs: 424-425. In some embodiments, the guide RNA structure comprises a sequence at least 70%, 80%, or 90% identical to a sequence selected from the group consisting of SEQ ID NOs: 5498-5499 and SEQ ID NO: 5539. In some embodiments, the guide RNA structure comprises a guide ribonucleic acid sequence predicted to comprise a hairpin with an uninterrupted base-paired region comprising at least 8 nucleotides of a guide ribonucleic acid sequence and at least 8 nucleotides of a tracr ribonucleic acid sequence, and wherein the tracr ribonucleic acid sequence comprises, from 5' to 3', a first hairpin and a second hairpin, wherein the first hairpin has a longer stem than the second hairpin.

In some embodiments, the endonuclease comprises a sequence at least 70%, 80%, or 90% identical to a sequence selected from the group consisting of SEQ ID NOs: 2242-2244 or SEQ ID NOs: 2247-2249. In some embodiments, the endonuclease comprises a sequence at least 70%, 80%, or 90% identical to a sequence selected from the group consisting of SEQ ID NOs: 4056-4058 and SEQ ID NOs 4061-4063. In some embodiments, the endonuclease comprises at least 1, at least 2, at least 3, at least 4, or at least 5 peptide motifs selected from the group consisting of SEQ ID NOs: 5639-5648. In some embodiments, the endonuclease comprises a sequence at least 70%, 80%, or 90% identical to a sequence selected from the group consisting of SEQ ID NOs: 421-423 or SEQ ID NOs: 426-428. In some embodiments, the guide RNA structure comprises a sequence at least 70%, 80%, or 90% identical to a sequence selected from the group consisting of SEQ ID NOs: 5466-5467, SEQ ID NOs: 5495-5497, SEQ ID NO: 5500-5502, and SEQ ID NO: 5539. In some embodiments, the guide RNA structure comprises a guide ribonucleic acid sequence predicted to comprise a hairpin with an uninterrupted base-paired region comprising at least 8 nucleotides of a guide ribonucleic acid sequence and at least 8 nucleotides of a tracr ribonucleic acid sequence, and wherein the tracr ribonucleic acid sequence comprises, from 5' to 3', a first hairpin and a second hairpin, wherein the first hairpin has a longer stem than the second hairpin. In some embodiments, the endonuclease is configured to binding to a PAM comprising a sequence selected from the group consisting of SEQ ID NOs: 5517-5518 or SEQ ID NOs: 5532-5534. In some embodiments: (a) the endonuclease comprises a sequence at least 70%, 80%, or 90% identical to SEQ ID NO: 2247; (b) the guide RNA structure comprises a sequence at least 70%, 80%, or 90% identical to SEQ ID NO: 5500; and (c) the endonuclease is configured to binding to a PAM comprising SEQ ID NO: 5517 or SEQ ID NO: 5532. In some embodiments: (a) the endonuclease comprises a sequence at least 70%, 80%, or 90% identical to SEQ ID NO: 2248; (b) the guide RNA structure comprises a sequence at least 70%, 80%, or 90% identical to SEQ ID NO: 5501; and (c) the endonuclease is configured to binding to a PAM comprising SEQ ID NO: 5518 or SEQ ID NOs: 5533. In some embodiments: (a) the endonuclease comprises a sequence at least 70%, 80%, or 90% identical to SEQ ID NO: 2249; (b) the guide RNA structure comprises a sequence at least 70%, 80%, or 90% identical to SEQ ID NO: 5502; and (c) the endonuclease is configured to binding to a PAM comprising SEQ ID NO: 5534.

In some embodiments, the endonuclease comprises a sequence at least 70%, 80%, or 90% identical to a sequence selected from the group consisting of SEQ ID NO: 2253 or SEQ ID NOs: 2253-2481. In some embodiments, the endonuclease comprises a sequence at least 70%, 80%, or 90% identical to a sequence selected from the group consisting of SEQ ID NO: 4067 or SEQ ID NOs: 4067-4295. In some embodiments, the endonuclease comprises a peptide motif according to SEQ ID NO: 5649. In some embodiments, the endonuclease comprises a sequence at least 70%, 80%, or 90% identical to a sequence selected from the group consisting of SEQ ID NO: 432 or SEQ ID NOs: 432-660. In some embodiments, the guide RNA structure comprises a sequence at least 70%, 80%, or 90% identical to a sequence selected from the group consisting of SEQ ID NO: 5468 or SEQ ID NO: 5503. In some embodiments, the endonuclease is configured to binding to a PAM comprising a sequence selected from the group consisting of SEQ ID NOs: 5519. In some embodiments: (a) the endonuclease comprises a sequence at least 70%, 80%, or 90% identical to SEQ ID NO: 2253; (b) the guide RNA structure comprises a sequence at least 70%, 80%, or 90% identical to SEQ ID NO: 5468 or SEQ ID NO: 5503; and (c) the endonuclease is configured to binding to a PAM comprising SEQ ID NO: 5519.

In some embodiments, the endonuclease comprises a sequence at least 70%, 80%, or 90% identical to a sequence selected from the group consisting of SEQ ID NOs: 2482-2489. In some embodiments, the endonuclease comprises a sequence at least 70%, 80%, or 90% identical to a sequence selected from the group consisting of SEQ ID NOs: 4296-4303. In some embodiments, the endonuclease comprises a sequence at least 70%, 80%, or 90% identical to a sequence selected from the group consisting of or SEQ ID NOs: 661-668. In some embodiments, the endonuclease comprises a sequence at least 70%, 80%, or 90% identical to a sequence selected from the group consisting of or SEQ ID NOs: 2490-2498. In some embodiments, the endonuclease comprises a sequence at least 70%, 80%, or 90% identical to a sequence selected from the group consisting of SEQ ID NOs: 4304-4312. In some embodiments, the endonuclease comprises a sequence at least 70%, 80%, or 90% identical to a sequence selected from the group consisting of SEQ ID NOs: 669-677. In some embodiments, the guide RNA structure comprises a sequence at least 70%, 80%, or 90% identical to a sequence selected from the group consisting of SEQ ID NO: 5504.

In some embodiments, the endonuclease comprises a sequence at least 70%, 80%, or 90% identical to a sequence selected from the group consisting of SEQ ID NO: 2499 or SEQ ID NOs: 2499-2750. In some embodiments, the endonuclease comprises a sequence at least 70%, 80%, or 90% identical to a sequence selected from the group consisting of SEQ ID NO: 4313 or SEQ ID NOs: 4313-4564. In some embodiments, the endonuclease comprises at least 1, at least 2, at least 3, at least 4, or at least 5 peptide motifs selected from the group consisting of SEQ ID NOs: 5650-5667. In some embodiments, the endonuclease comprises a sequence at least 70%, 80%, or 90% identical to a sequence selected from the group consisting of SEQ ID NO: 678 or SEQ ID NOs: 678-929. In some embodiments, the guide RNA structure comprises a sequence at least 70%, 80%, or 90% identical to SEQ ID NO: 5469 or SEQ ID NO: 5505. In some embodiments, the endonuclease is configured to binding to a PAM comprising SEQ ID NOs: 5520 or SEQ ID NOs: 5535. In some embodiments: (a) the endonuclease comprises a sequence at least 70%, 80%, or 90% identical to SEQ ID NO: 2499; (b) the guide RNA structure comprises a sequence at least 70%, 80%, or 90% identical to SEQ ID NO: 5469 or SEQ ID NO: 5505; and (c) the endonuclease is configured to binding to a PAM comprising SEQ ID NO: 5520 or SEQ ID NO: 5535.

In some embodiments, the endonuclease comprises a sequence at least 70%, 80%, or 90% identical to a sequence selected from the group consisting of SEQ ID NO: 2751 or SEQ ID NOs: 2751-2913. In some embodiments, the endonuclease comprises a sequence at least 70%, 80%, or 90% identical to a sequence selected from the group consisting of SEQ ID NO: 4565 or SEQ ID NOs: 4565-4727. In some embodiments, the endonuclease comprises at least 1, at least 2, at least 3, at least 4, or at least 5 peptide motifs selected from the group consisting of SEQ ID NOs: 5668-5678. In some embodiments, the endonuclease comprises a sequence at least 70%, 80%, or 90% identical to a sequence selected from the group consisting of SEQ ID NO: 930 or SEQ ID NOs: 930-1092. In some embodiments, the guide RNA structure comprises a sequence at least 70%, 80%, or 90% identical to SEQ ID NO: 5470 or SEQ ID NOs: 5506. In some embodiments, the endonuclease is configured to binding to a PAM comprising a sequence selected from the group consisting of SEQ ID NOs: 5521 or SEQ ID NOs: 5536. In some embodiments: (a) the endonuclease comprises a sequence at least 70%, 80%, or 90% identical to SEQ ID NO: 2751; (b) the guide RNA structure comprises a sequence at least 70%, 80%, or 90% identical to SEQ ID NO: 5470 or SEQ ID NO: 5506; and (c) the endonuclease is configured to binding to a PAM comprising SEQ ID NO: 5521 or SEQ ID NO: 5536.

In some embodiments, the endonuclease comprises a sequence at least 70%, 80%, or 90% identical to a sequence selected from the group consisting of SEQ ID NO: 2914 or SEQ ID NOs: 2914-3174. In some embodiments, the endonuclease comprises a sequence at least 70%, 80%, or 90% identical to a sequence selected from the group consisting of SEQ ID NO: 4728 or SEQ ID NOs: 4728-4988. In some embodiments, the endonuclease comprises at least 1, at least 2, or at least 3 peptide motifs selected from the group consisting of SEQ ID NOs: 5676-5678. In some embodiments, the endonuclease comprises a sequence at least 70%, 80%, or 90% identical to a sequence selected from the group consisting of SEQ ID NO: 1093 or SEQ ID NOs: 1093-1353. In some embodiments, the guide RNA structure comprises a sequence at least 70%, 80%, or 90% identical to a sequence selected from the group consisting of SEQ ID NO: 5471, SEQ ID NO: 5507, and SEQ ID NOs: 5540-5542. In some embodiments, the guide RNA structure comprises a tracr ribonucleic acid sequence predicted to comprise at least two hairpins comprising less than 5 base-paired ribonucleotides. In some embodiments, the endonuclease is configured to binding to a PAM comprising SEQ ID NO: 5522. In some embodiments: (a) the endonuclease comprises a sequence at least 70%, 80%, or 90% identical to SEQ ID NO: 2914; (b) the guide RNA structure comprises a sequence at least 70%, 80%, or 90% identical to SEQ ID NO: 5471 or SEQ ID NO: 5507; and (c) the endonuclease is configured to binding to a PAM comprising SEQ ID NO: 5522.

In some embodiments, the endonuclease comprises a sequence at least 70%, 80%, or 90% identical to a sequence selected from the group consisting of SEQ ID NO: 3175 or SEQ ID NOs: 3175-3330. In some embodiments, the endonuclease comprises a sequence at least 70%, 80%, or 90% identical to a sequence selected from the group consisting of SEQ ID NO: 4989 or SEQ ID NOs: 4989-5146. In some embodiments, the endonuclease comprises at least 1, at least 2, at least 3, at least 4, or at least 5 peptide motifs selected from the group consisting of SEQ ID NOs: 5679-5686. In some embodiments, the endonuclease comprises a sequence at least 70%, 80%, or 90% identical to a sequence selected from the group consisting of SEQ ID NO: 1354 or SEQ ID NOs: 1354-1511. In some embodiments, the guide RNA structure comprises a sequence at least 70%, 80%, or 90% identical to a sequence selected from the group consisting of SEQ ID NOs: 5472 or SEQ ID NOs: 5508. In some embodiments, the endonuclease is configured to binding to a PAM comprising a sequence selected from the group consisting of SEQ ID NO: 5523 or SEQ ID NO: 5537. In some embodiments: (a) the endonuclease comprises a sequence at least 70%, 80%, or 90% identical to SEQ ID NO: 3175; (b) the guide RNA structure comprises a sequence at least 70%, 80%, or 90% identical to SEQ ID NO: 5472 or SEQ ID NO: 5508; and (c) the endonuclease is configured to binding to a PAM comprising SEQ ID NO: 5523 or SEQ ID NO: 5537.

In some embodiments, the endonuclease comprises a sequence at least 70%, 80%, or 90% identical to a sequence selected from the group consisting of SEQ ID NOs: 3331 or SEQ ID NOs: 3331-3474. In some embodiments, the endonuclease comprises a sequence at least 70%, 80%, or 90% identical to a sequence selected from the group consisting of SEQ ID NOs: 5147 or SEQ ID NOs: 5147-5290. In some embodiments, the endonuclease comprises at least 1, at least 2, at least 3, at least 4, or at least 5 peptide motifs selected from the group consisting of SEQ ID NOs: 5674-5675 and SEQ ID NOs: 5687-5693. In some embodiments, the endonuclease comprises a sequence at least 70%, 80%, or 90% identical to a sequence selected from the group consisting of SEQ ID NO: 1512 or SEQ ID NOs: 1512-1655. In some embodiments, the guide RNA structure comprises a sequence at least 70%, 80%, or 90% identical to a sequence selected from the group consisting of SEQ ID NO: 5473 or SEQ ID NO: 5509. In some embodiments, the endonuclease is configured to binding to a PAM comprising SEQ ID NO: 5524. In some embodiments: (a) the endonuclease comprises a sequence at least 70%, 80%, or 90% identical to SEQ ID NO: 3331; (b) the guide RNA structure comprises a sequence at least 70%, 80%, or 90% identical to SEQ ID NO: 5473 or SEQ ID NO: 5509; and (c) the endonuclease is configured to binding to a PAM comprising SEQ ID NO: 5524.

In some embodiments, the endonuclease comprises a sequence at least 70%, 80%, or 90% identical to a sequence selected from the group consisting of SEQ ID NO: 3475 or SEQ ID NOs: 3475-3568. In some embodiments, the endonuclease comprises a sequence at least 70%, 80%, or 90% identical to a sequence selected from the group consisting of SEQ ID NO: 5291 or SEQ ID NOs: 5291-5389. In some embodiments, the endonuclease comprises at least 1, at least 2, at least 3, at least 4, or at least 5 peptide motifs selected from the group consisting of SEQ ID NOs: 5694-5699. In some embodiments, the endonuclease comprises a sequence at least 70%, 80%, or 90% identical to a sequence selected from the group consisting of SEQ ID NO: 1656 or SEQ ID NOs: 1656-1755. In some embodiments, the guide RNA structure comprises a sequence at least 70%, 80%, or 90% identical to SEQ ID NO: 5474 or SEQ ID NO: 5510. In some embodiments, the endonuclease is configured to binding to a PAM comprising SEQ ID NOs: 5525. In some embodiments: (a) the endonuclease comprises a sequence at least 70%, 80%, or 90% identical to SEQ ID NO: 3475; (b) the guide RNA structure comprises a sequence at least 70%, 80%, or 90% identical to SEQ ID NO: 5474 or SEQ ID NO: 5510; and (c) the endonuclease is configured to binding to a PAM comprising SEQ ID NO: 5525.

In some embodiments, the endonuclease comprises a sequence at least 70%, 80%, or 90% identical to a sequence selected from the group consisting of SEQ ID NO: 3569 or SEQ ID NOs: 3569-3637. In some embodiments, the endonuclease comprises a sequence at least 70%, 80%, or 90% identical to a sequence selected from the group consisting of SEQ ID NO: 5390 or SEQ ID NOs: 5390-5460. In some embodiments, the endonuclease comprises at least 1, at least 2, at least 3, at least 4, or at least 5 peptide motifs selected from the group consisting of SEQ ID NOs: 5700-5717. In some embodiments, the endonuclease comprises a sequence at least 70%, 80%, or 90% identical to a sequence selected from the group consisting of SEQ ID NO: 1756 or SEQ ID NOs: 1756-1826. In some embodiments, the guide RNA structure comprises a sequence at least 70%, 80%, or 90% identical to SEQ ID NO: 5475 or SEQ ID NO: 5511. In some embodiments, the endonuclease is configured to binding to a PAM comprising SEQ ID NO: 5526. In some embodiments: (a) the endonuclease comprises a sequence at least 70%, 80%, or 90% identical to SEQ ID NO: 3569; (b) the guide RNA structure comprises a sequence at least 70%, 80%, or 90% identical to SEQ ID NO: 5475 or SEQ ID NO: 5511; and (c) the endonuclease is configured to binding to a PAM comprising SEQ ID NO: 5526. In some embodiments, the sequence identity is determined by a BLASTP, CLUSTALW, MUSCLE, MAFFT, or Smith-Waterman homology search algorithm. In some embodiments, the sequence identity is determined by the BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment.

In some aspects, the present disclosure provides for an engineered guide ribonucleic acid polynucleotide comprising: (a) a DNA-targeting segment comprising a nucleotide sequence that is complementary to a target sequence in a target DNA molecule; and (b) a protein-binding segment comprising two complementary stretches of nucleotides that hybridize to form a double-stranded RNA (dsRNA) duplex, wherein the two complementary stretches of nucleotides are covalently linked to one another with intervening nucleotides, and wherein the engineered guide ribonucleic acid polynucleotide is configured to forming a complex with an endonuclease comprising a RuvC_III domain having at least 75% sequence identity to any one of SEQ ID NOs: 1827-3637 and targeting the complex to the target sequence of the target DNA molecule. In some embodiments, the DNA-targeting segment is positioned 5' of both of the two complementary stretches of nucleotides.

In some embodiments: (a) the protein binding segment comprises a sequence having at least 70%, at least 80%, or at least 90% identity to a sequence selected from the group consisting of SEQ ID NOs: 5476-5479 or SEQ ID NOs: 5476-5489; (b) the protein binding segment comprises a sequence having at least 70%, at least 80%, or at least 90% identity to a sequence selected from the group consisting of (SEQ ID NOs: 5490-5491 or SEQ ID NOs: 5490-5494) and SEQ ID NO: 5538; (c) the protein binding segment comprises a sequence having at least 70%, at least 80%, or at least 90% identity to a sequence selected from the group consisting of SEQ ID NOs: 5498-5499; (d) the protein binding segment comprises a sequence having at least 70%, at least 80%, or at least 90% identity to a sequence selected from the group consisting of SEQ ID NOs: 5495-5497 and SEQ ID NOs: 5500-5502; (e) the protein binding segment comprises a sequence having at least 70%, at least 80%, or at least 90% identity to SEQ ID NO: 5503; (0 the protein binding segment comprises a sequence having at least 70%, at least 80%, or at least 90% identity to SEQ ID NO: 5504; (g) the protein binding segment comprises a sequence having at least 70%, at least 80%, or at least 90% identity to SEQ ID NOs: 5505; (h) protein binding segment comprises a sequence having at least 70%, at least 80%, or at least 90% identity to SEQ ID NO: 5506; (i) protein binding segment comprises a sequence having at least 70%, at least 80%, or at least 90% identity to SEQ ID NO: 5507; (j) the protein binding segment comprises a sequence having at least 70%, at least 80%, or at least 90% identity to SEQ ID NO: 5508; (k) the protein binding segment comprises a sequence having at least 70%, at least 80%, or at least 90% identity to SEQ ID NO: 5509; (1) the protein binding segment comprises a sequence having at least 70%, at least 80%, or at least 90% identity to SEQ ID NO: 5510; or (m) the protein binding segment comprises a sequence having at least 70%, at least 80%, or at least 90% identity to SEQ ID NO: 5511.

In some embodiments: (a) the guide ribonucleic acid polynucleotide comprises an RNA sequence comprising a hairpin comprising a stem and a loop, wherein the stem comprises at least 10, at least 12, or at least 14 base-paired ribonucleotides, and an asymmetric bulge within 4 base pairs of the loop; (b) the guide ribonucleic acid polynucleotide comprises a tracr ribonucleic acid sequence predicted to comprise a hairpin comprising at least 8, at least 10, or at least 12 base-paired ribonucleotides; (c) the guide ribonucleic acid polynucleotide comprises a guide ribonucleic acid sequence predicted to comprise a hairpin with an uninterrupted base-paired region comprising at least 8 nucleotides of a guide ribonucleic acid sequence and at least 8 nucleotides of a tracr ribonucleic acid sequence, and wherein the tracr ribonucleic acid sequence comprises, from 5' to 3', a first hairpin and a second hairpin, wherein the first hairpin has a longer stem than the second hairpin; or (d) the guide ribonucleic acid polynucleotide comprises a tracr ribonucleic acid sequence predicted to comprise at least two hairpins comprising less than 5 base-paired ribonucleotides.

In some aspects, the present disclosure provides for a deoxyribonucleic acid polynucleotide encoding any of the engineered guide ribonucleic acid polynucleotides described herein.

In some aspects, the present disclosure provides for a nucleic acid comprising an engineered nucleic acid sequence optimized for expression in an organism, wherein the nucleic acid encodes a class 2, type II Cas endonuclease comprising a RuvC_III domain and an HNH domain, and wherein the endonuclease is derived from an uncultivated microorganism.

In some aspects, the present disclosure provides for a nucleic acid comprising an engineered nucleic acid sequence optimized for expression in an organism, wherein the nucleic acid encodes an endonuclease comprising a RuvC_III domain having at least 70% sequence identity to any one of SEQ ID NOs: 1827-3637. In some embodiments, the endonuclease comprises an HNH domain having at least 70% or at least 80% sequence identity to any one of SEQ ID NOs: 3638-5460. In some embodiments, the endonuclease comprises SEQ ID NOs: 5572-5591 or a variant thereof having at least 70% sequence identity thereto. In some embodiments, the endonuclease comprises a sequence encoding one or more nuclear localization sequences (NLSs) proximal to an N- or C-terminus of the endonuclease. In some embodiments, the NLS comprises a sequence selected from SEQ ID NOs: 5597-5612.

In some embodiments, the organism is prokaryotic, bacterial, eukaryotic, fungal, plant, mammalian, rodent, or human. In some embodiments, the organism is *E. coli*, and: (a) the nucleic acid sequence has at least 70%, 80%, or 90% identity to a sequence selected from the group consisting of SEQ ID NOs: 5572-5575; (b) the nucleic acid sequence has at least 70%, 80%, or 90% identity to a sequence selected from the group consisting of SEQ ID NOs: 5576-5577; (c) the nucleic acid sequence has at least 70%, 80%, or 90% identity to a sequence selected from the group consisting of SEQ ID NOs: 5578-5580; (d) the nucleic acid sequence has at least 70%, 80%, or 90% identity to SEQ ID NO: 5581; (e) the nucleic acid sequence has at least 70%, 80%, or 90% identity to SEQ ID NO: 5582; (f) the nucleic acid sequence has at least 70%, 80%, or 90% identity to SEQ ID NO: 5583; (g) the nucleic acid sequence has at least 70%, 80%, or 90% identity to SEQ ID NO: 5584; (h) the nucleic acid sequence has at least 70%, 80%, or 90% identity to SEQ ID NO: 5585; (i) the nucleic acid sequence has at least 70%, 80%, or 90% identity to SEQ ID NO: 5586; or (j) the nucleic acid sequence has at least 70%, 80%, or 90% identity to SEQ ID NO: 5587. In some embodiments, the organism is human, and: (a) the nucleic acid sequence has at least 70%, 80%, or 90% identity to SEQ ID NO: 5588 or SEQ ID NO: 5589; or (b) the nucleic acid sequence has at least 70%, 80%, or 90% identity to SEQ ID NO: 5590 or SEQ ID NO: 5591.

In some aspects, the present disclosure provides for a vector comprising a nucleic acid sequence encoding a class 2, type II Cas endonuclease comprising a RuvC_III domain and an HNH domain, wherein the endonuclease is derived from an uncultivated microorganism.

In some aspects, the present disclosure provides for a vector comprising the any of the nucleic acids described herein. In some embodiments, the vector further comprises a nucleic acid encoding an engineered guide ribonucleic acid structure configured to form a complex with the endonuclease comprising: (a) a guide ribonucleic acid sequence configured to hybridize to a target deoxyribonucleic acid sequence; and (b) a tracr ribonucleic acid sequence configured to binding to the endonuclease. In some embodiments, the vector is a plasmid, a minicircle, a CELiD, an adeno-associated virus (AAV) derived virion, or a lentivirus.

In some aspects, the present disclosure provides for a cell comprising any of the vectors described herein.

In some aspects, the present disclosure provides for a method of manufacturing an endonuclease, comprising cultivating any of the cells described herein.

In some aspects, the present disclosure provides for a method for binding, cleaving, marking, or modifying a double-stranded deoxyribonucleic acid polynucleotide, comprising: (a) contacting the double-stranded deoxyribonucleic acid polynucleotide with a class 2, type II Cas endonuclease in complex with an engineered guide ribonucleic acid structure configured to bind to the endonuclease and the double-stranded deoxyribonucleic acid polynucleotide; (b) wherein the double-stranded deoxyribonucleic acid polynucleotide comprises a protospacer adjacent motif (PAM); and (c) wherein the PAM comprises a sequence selected from the group consisting of SEQ ID NOs: 5512-5526 or SEQ ID NOs: 5527-5537. In some embodiments, the double-stranded deoxyribonucleic acid polynucleotide comprises a first strand comprising a sequence complementary to a sequence of the engineered guide ribonucleic acid structure and a second strand comprising the PAM. In some embodiments, the PAM is directly adjacent to the 3' end of the sequence complementary to the sequence of the engineered guide ribonucleic acid structure.

In some embodiments, the class 2, type II Cas endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, the class 2, type II Cas endonuclease is derived from an uncultivated microorganism. In some embodiments, the double-stranded deoxyribonucleic acid polynucleotide is a eukaryotic, plant, fungal, mammalian, rodent, or human double-stranded deoxyribonucleic acid polynucleotide.

In some embodiments: (a) the PAM comprises a sequence selected from the group consisting of SEQ ID NOs: 5512-5515 and SEQ ID NOs: 5527-5530; (b) the PAM comprises SEQ ID NO: 5516 or SEQ ID NO: 5531; (c) the PAM comprises SEQ ID NO: 5539; (d) the PAM comprises SEQ ID NO: 5517 or SEQ ID NO: 5518; (e) the PAM comprises SEQ ID NO: 5519; (f) the PAM comprises SEQ ID NO: 5520 or SEQ ID NO: 5535; (g) the PAM comprises SEQ ID NO: 5521 or SEQ ID NO: 5536; (h) the PAM comprises SEQ ID NO: 5522; (i) the PAM comprises SEQ ID NO: 5523 or SEQ ID NO: 5537; (j) the PAM comprises SEQ ID NO: 5524; (k) the PAM comprises SEQ ID NO: 5525; or (1) the PAM comprises SEQ ID NO: 5526.

In some aspects, the present disclosure provides for a method of modifying a target nucleic acid locus, the method comprising delivering to the target nucleic acid locus any of the engineered nuclease systems described herein, wherein the endonuclease is configured to form a complex with the engineered guide ribonucleic acid structure, and wherein the complex is configured such that upon binding of the complex to the target nucleic acid locus, the complex modifies the target nucleic acid locus. In some embodiments, modifying the target nucleic acid locus comprises binding, nicking, cleaving, or marking the target nucleic acid locus. In some embodiments, the target nucleic acid locus comprises deoxyribonucleic acid (DNA) or ribonucleic acid (RNA). In some embodiments, the target nucleic acid comprises genomic DNA, viral DNA, viral RNA, or bacterial DNA. In some embodiments, the target nucleic acid locus is in vitro. In some embodiments, the target nucleic acid locus is within a cell. In some embodiments, the cell is a prokaryotic cell, a bacterial cell, a eukaryotic cell, a fungal cell, a plant cell, an animal cell, a mammalian cell, a rodent cell, a primate cell, or a human cell.

In some embodiments, delivering the engineered nuclease system to the target nucleic acid locus comprises delivering a nucleic acid comprising: (i) an engineered nucleic acid sequence optimized for expression in an organism, wherein said nucleic acid encodes a class 2, type II Cas endonuclease comprising a RuvC III domain and an HNH domain, and wherein said endonuclease is derived from an uncultivated microorganism or (ii) an engineered nucleic acid sequence optimized for expression in an organism, wherein said nucleic acid encodes an endonuclease comprising a RuvC III domain having at least 70% sequence identity to any one of SEQ ID NOs: 1827-3637, wherein the endonuclease optionally: (a) comprises an HNH domain having at least 70% or at least 80% sequence identity to any one of SEQ ID NOs: 3638-5460; (b) comprises SEQ ID NOs: 5572-5591 or a variant thereof having at least 70% sequence identity thereto; (c) comprises a sequence encoding one or more nuclear localization sequences (NLSs) proximal to an N- or C-terminus of said endonuclease; or (d) comprises a sequence encoding one or more nuclear localization sequences (NLSs) proximal to an N- or C-terminus of said endonuclease wherein said NLS comprises a sequence selected from SEQ ID NOs: 5597-5612. In some embodiments, delivering the engineered nuclease system to the target nucleic acid locus comprises delivering a nucleic acid-comprising an open reading frame encoding the endonuclease. In some embodiments, the-nucleic acid comprises a promoter to which the open reading frame encoding the endonuclease is operably linked. In some embodiments, the engineered nuclease system to the target nucleic acid locus comprises delivering a capped mRNA containing the open reading frame encoding the endonuclease. In some embodiments, the engineered nuclease system to the target nucleic acid locus comprises delivering a translated polypeptide. In some embodiments, the engineered nuclease system to the target nucleic acid locus comprises delivering a deoxyribonucleic acid (DNA) encoding the engineered guide ribonucleic acid structure operably linked to a ribonucleic acid (RNA) pol III promoter. In some embodiments, the endonuclease induces a single-stranded break or a double-stranded break at or proximal to the target locus.

Additional aspects and advantages of the present disclosure will become readily apparent to those skilled in this art from the following detailed description, wherein only illustrative embodiments of the present disclosure are shown and described. As will be realized, the present disclosure is capable of other and different embodiments, and its several details are capable of modifications in various obvious respects, all without departing from the disclosure. Accordingly, the drawings and description are to be regarded as illustrative in nature, and not as restrictive.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings (also "Figure" and "FIG." herein), of which:

Figure 6:
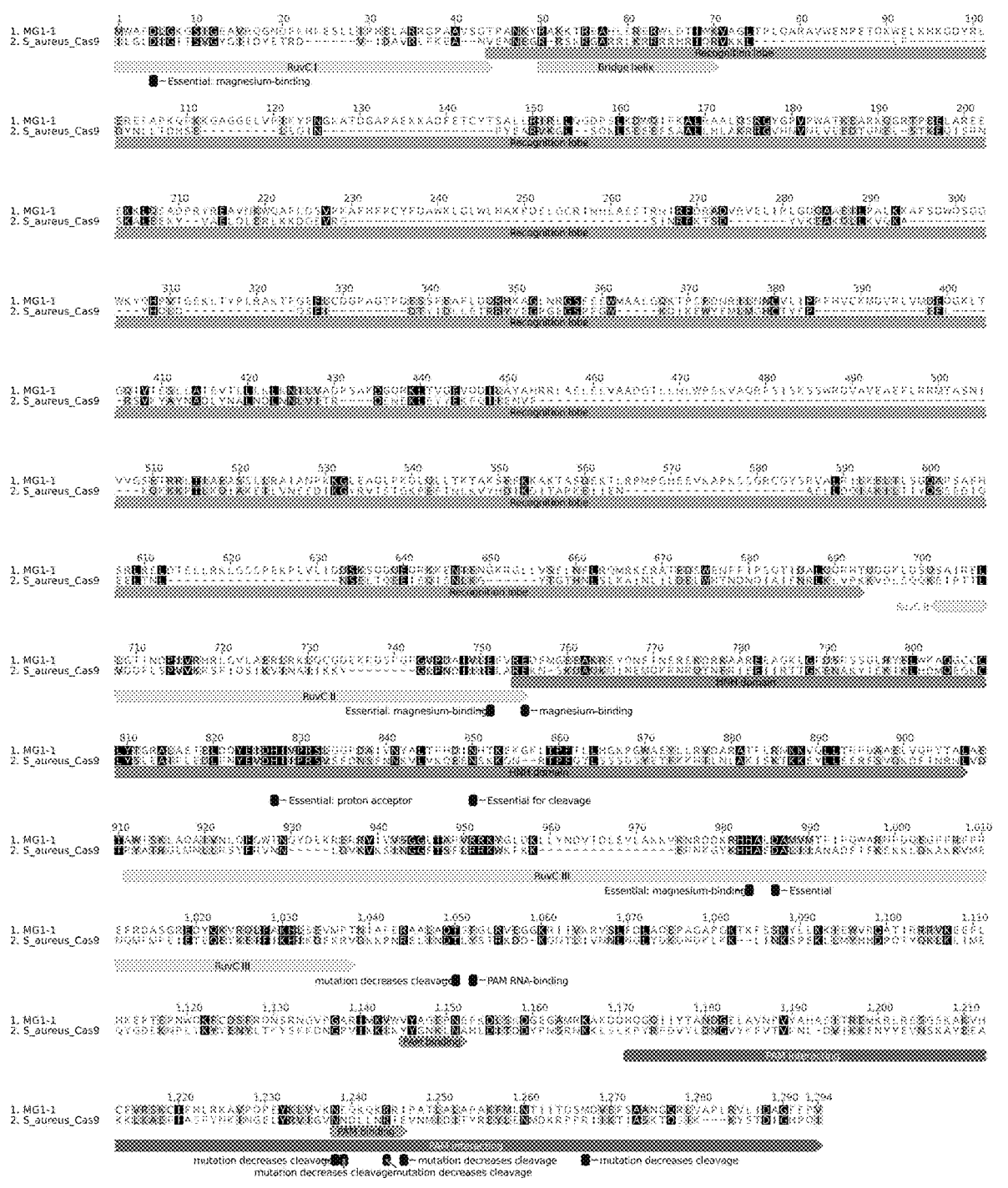

FIG. 6 depicts a structure-based alignment of an enzyme of the present disclosure (MG1-1) versus Cas9 from *Staphylococcus aureus* (SEQ ID NO:5613).

FIG. 8 depicts a structure-based alignment of an enzyme of the present disclosure (MG3-1) versus Cas9 from *Actinomyces naeslundii* (SEQ ID NO: 5614).

BRIEF DESCRIPTION OF THE SEQUENCE LISTING

Figure 1:
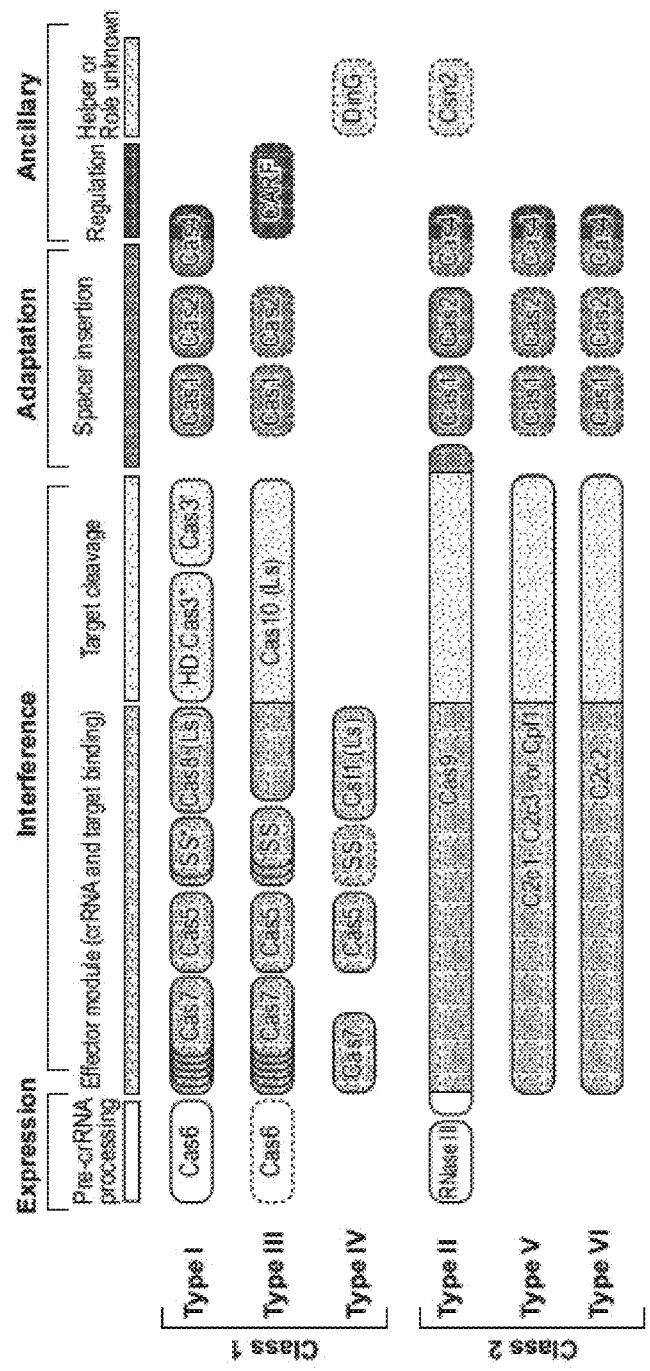
FIG. 1 depicts typical organizations of CRISPR/Cas loci of different classes and types.

The Sequence Listing filed herewith provides exemplary polynucleotide and polypeptide sequences for use in methods, compositions and systems according to the disclosure. Below are exemplary descriptions of sequences therein.

MG1

SEQ ID NOs: 1-319 show the full-length peptide sequences of MG1 nucleases.

SEQ ID NOs: 1827-2140 show the peptide sequences of RuvC_III domains of MG1 nucleases above.

SEQ ID NOs: 3638-3955 show the peptide of HNH domains of MG1 nucleases above.

SEQ ID NOs: 5476-5479 show the nucleotide sequences of MG1 tracrRNAs derived from the same loci as MG1 nucleases above (e.g., same loci as SEQ ID NO:1-4, respectively).

SEQ ID NOs: 5461-5464 show the nucleotide sequences of sgRNAs engineered to function with an MG1 nuclease (e.g., SEQ ID NO:1-4, respectively), where Ns denote nucleotides of a targeting sequence.

SEQ ID NOs: 5572-5575 show nucleotide sequences for E. coli codon-optimized coding sequences for MG1 family enzymes (SEQ ID NOs: 1-4).

SEQ ID NOs: 5588-5589 show nucleotide sequences for human codon-optimized coding sequences for MG1 family enzymes (SEQ ID NOs: 1 and 3).

SEQ ID NOs: 5616-5632 show peptide motifs characteristic of MG1 family enzymes.

MG2

SEQ ID NOs: 320-420 show the full-length peptide sequences of MG2 nucleases.

SEQ ID NOs: 2141-2241 show the peptide sequences of RuvC_III domains of MG2 nucleases above.

SEQ ID NOs: 3955-4055 show the peptide of HNH domains of MG2 nucleases above.

SEQ ID NOs: 5490-5494 show the nucleotide sequences of MG2 tracrRNAs derived from the same loci as MG2 nucleases above (e.g., same loci as SEQ ID NOs: 320, 321, 323, 325, and 326, respectively).

SEQ ID NO: 5465 shows the nucleotide sequence of an sgRNA engineered to function with an MG2 nuclease (e.g., SEQ ID NO: 321 above).

SEQ ID NOs: 5572-5575 show nucleotide sequences for E. coli codon-optimized coding sequences for MG2 family enzymes.

SEQ ID NOs: 5631-5638 show peptide sequences characteristic of MG2 family enzymes.

MG3

SEQ ID NOs: 421-431 show the full-length peptide sequences of MG3 nucleases.

SEQ ID NOs: 2242-2252 show the peptide sequences of RuvC_III domains of MG3 nucleases above.

SEQ ID NOs: 4056-4066 show the peptide of HNH domains of MG3 nucleases above.

SEQ ID NOs: 5495-5502 show the nucleotide sequences of MG3 tracrRNAs derived from the same loci as MG3 nucleases above (e.g., same loci as SEQ ID NOs: 421-428, respectively).

SEQ ID NOs: 5466-5467 show the nucleotide sequence of sgRNAs engineered to function with an MG3 nuclease (e.g., SEQ ID NOs: 421-423).

SEQ ID NOs: 5578-5580 show nucleotide sequences for E. coli codon-optimized coding sequences for MG3 family enzymes.

SEQ ID NOs: 5639-5648 show peptide sequences characteristic of MG3 family enzymes.

MG4

SEQ ID NOs: 432-660 show the full-length peptide sequences of MG4 nucleases.

SEQ ID NOs: 2253-2481 show the peptide sequences of RuvC_III domains of MG4 nucleases above.

SEQ ID NOs: 4067-4295 show the peptide of HNH domains of MG4 nucleases above.

SEQ ID NO: 5503 shows the nucleotide sequences of an MG4 tracrRNA derived from the same loci as MG4 nucleases above.

SEQ ID NO: 5468 shows the nucleotide sequence of sgRNAs engineered to function with an MG4 nuclease.

SEQ ID NO: 5649 shows a peptide sequence characteristic of MG4 family enzymes.

MG6

SEQ ID NOs: 661-668 show the full-length peptide sequences of MG6 nucleases.

SEQ ID NOs: 2482-2489 show the peptide sequences of RuvC_III domains of MG6 nucleases above.

SEQ ID NOs: 4296-4303 show the peptide of HNH domains of MG3 nucleases above.

MG7

SEQ ID NOs: 669-677 show the full-length peptide sequences of MG7 nucleases.

SEQ ID NOs: 2490-2498 show the peptide sequences of RuvC_III domains of MG7 nucleases above.

SEQ ID NOs: 4304-4312 show the peptide of HNH domains of MG3 nucleases above.

SEQ ID NO: 5504 shows the nucleotide sequence of an MG7 tracrRNA derived from the same loci as MG7 nucleases above.

MG14

SEQ ID NOs: 678-929 show the full-length peptide sequences of MG14 nucleases.

SEQ ID NOs: 2499-2750 show the peptide sequences of RuvC_III domains of MG14 nucleases above.

SEQ ID NOs: 4313-4564 show the peptide of HNH domains of MG14 nucleases above.

SEQ ID NO: 5505 shows the nucleotide sequences of MG14 tracrRNA derived from the same loci as MG14 nucleases above.

SEQ ID NO: 5581 shows a nucleotide sequence for an E. coli codon-optimized coding sequences for an MG14 family enzyme.

SEQ ID NOs: 5650-5667 show peptide sequences characteristic of MG14 family enzymes.

MG15

SEQ ID NOs: 930-1092 show the full-length peptide sequences of MG15 nucleases.

SEQ ID NOs: 2751-2913 show the peptide sequences of RuvC_III domains of MG15 nucleases above.

SEQ ID NOs: 4565-4727 show the peptide of HNH domains of MG15 nucleases above.

SEQ ID NO: 5506 shows the nucleotide sequences of MG15 tracrRNA derived from the same loci as MG15 nucleases above.

SEQ ID NO: 5470 shows the nucleotide sequence of an sgRNA engineered to function with an MG15 nuclease.

SEQ ID NO: 5582 shows a nucleotide sequence for an E. coli codon-optimized coding sequences for an MG15 family enzyme.

SEQ ID NOs: 5668-5675 show peptide sequences characteristic of MG15 family enzymes.

MG16

SEQ ID NOs: 1093-1353 show the full-length peptide sequences of MG16 nucleases.

SEQ ID NOs: 2914-3174 show the peptide sequences of RuvC_III domains of MG16 nucleases above.

SEQ ID NOs: 4728-4988 show the peptide of HNH domains of MG16 nucleases above.

SEQ ID NOs: 5507 show the nucleotide sequences of an MG16 tracrRNA derived from the same loci as MG3 nucleases above.

SEQ ID NOs: 5471 shows the nucleotide sequence of sgRNAs engineered to function with an MG16 nuclease.

SEQ ID NO: 5583 shows a nucleotide sequence for an *E. coli* codon-optimized coding sequences for an MG16 family enzyme.

SEQ ID NOs: 5676-5678 show peptide sequences characteristic of MG16 family enzymes.

MG18

SEQ ID NOs: 1354-1511 show the full-length peptide sequences of MG18 nucleases.

SEQ ID NOs: 3175-3330 show the peptide sequences of RuvC_III domains of MG18 nucleases above.

SEQ ID NOs: 4989-5146 show the peptide of HNH domains of MG18 nucleases above.

SEQ ID NO: 5508 shows the nucleotide sequences of MG18 tracrRNA derived from the same loci as MG18 nucleases above.

SEQ ID NOs: 5472 shows the nucleotide sequence of an sgRNA engineered to function with an MG18 nuclease.

SEQ ID NO: 5584 shows a nucleotide sequence for an *E. coli* codon-optimized coding sequences for an MG18 family enzyme.

SEQ ID NOs: 5679-5686 show peptide sequences characteristic of MG18 family enzymes.

MG21

SEQ ID NOs: 1512-1655 show the full-length peptide sequences of MG21 nucleases.

SEQ ID NOs: 3331-3474 show the peptide sequences of RuvC_III domains of MG21 nucleases above.

SEQ ID NOs: 5147-5290 show the peptide of HNH domains of MG21 nucleases above.

SEQ ID NOs: 5509 show the nucleotide sequence of an MG21 tracrRNA derived from the same loci as MG21 nucleases above.

SEQ ID NOs: 5473 shows the nucleotide sequence of an sgRNA engineered to function with an MG21 nuclease.

SEQ ID NO: 5585 shows a nucleotide sequence for an *E. coli* codon-optimized coding sequences for an MG21 family enzyme.

SEQ ID NOs: 5687-5692 and 5674-5675 show peptide sequences characteristic of MG21 family enzymes.

MG22

SEQ ID NOs: 1656-1755 show the full-length peptide sequences of MG22 nucleases.

SEQ ID NOs: 3475-3568 show the peptide sequences of RuvC_III domains of MG22 nucleases above.

SEQ ID NOs: 5291-5389 show the peptide of HNH domains of MG22 nucleases above.

SEQ ID NO: 5510 show the nucleotide sequence of an MG22 tracrRNA derived from the same loci as MG22 nucleases above.

SEQ ID NOs: 5474 shows the nucleotide sequence of an sgRNAs engineered to function with an MG22 nuclease.

SEQ ID NO: 5586 shows a nucleotide sequence for an *E. coli* codon-optimized coding sequences for an MG22 family enzyme.

SEQ ID NOs: 5694-5699 show peptide sequences characteristic of MG22 family enzymes.

MG23

SEQ ID NOs: 1756-1826 show the full-length peptide sequences of MG23 nucleases.

SEQ ID NOs: 3569-3637 show the peptide sequences of RuvC_III domains of MG23 nucleases above.

SEQ ID NOs: 5390-5460 show the peptide of HNH domains of MG23 nucleases above.

SEQ ID NO: 5511 shows the nucleotide sequences of an MG23 tracrRNA derived from the same loci as MG23 nucleases above.

SEQ ID NOs: 5475 shows the nucleotide sequence of an sgRNA engineered to function with an MG23 nuclease.

SEQ ID NO: 5587 shows a nucleotide sequence for an *E. coli* codon-optimized coding sequences for an MG23 family enzyme.

SEQ ID NOs: 5700-5717 show peptide sequences characteristic of MG23 family enzymes.

DETAILED DESCRIPTION

While various embodiments of the invention have been shown and described herein, it will be obvious to those skilled in the art that such embodiments are provided by way of example only. Numerous variations, changes, and substitutions may occur to those skilled in the art without departing from the invention. It should be understood that various alternatives to the embodiments of the invention described herein may be employed.

The practice of some methods disclosed herein employ, unless otherwise indicated, techniques of immunology, biochemistry, chemistry, molecular biology, microbiology, cell biology, genomics and recombinant DNA. See for example Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)) (which is entirely incorporated by reference herein).

As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising".

The term "about" or "approximately" means within an acceptable error range for the particular value as determined by one of ordinary skill in the art, which will depend in part on how the value is measured or determined, i.e., the limitations of the measurement system. For example, "about" can mean within one or more than one standard deviation, per the practice in the art. Alternatively, "about" can mean a range of up to 20%, up to 15%, up to 10%, up to 5%, or up to 1% of a given value.

As used herein, a "cell" generally refers to a biological cell. A cell may be the basic structural, functional and/or biological unit of a living organism. A cell may originate from any organism having one or more cells. Some non-limiting examples include: a prokaryotic cell, eukaryotic cell, a bacterial cell, an archaeal cell, a cell of a single-cell eukaryotic organism, a protozoa cell, a cell from a plant (e.g., cells from plant crops, fruits, vegetables, grains, soy bean, corn, maize, wheat, seeds, tomatoes, rice, cassava, sugarcane, pumpkin, hay, potatoes, cotton, cannabis, tobacco, flowering plants, conifers, gymnosperms, ferns, clubmosses, hornworts, liverworts, mosses), an algal cell, (e.g., *Botryococcus braunii*, *Chlamydomonas reinhardtii*, *Nannochloropsis gaditana*, *Chlorella pyrenoidosa*, *Sargassum patens* C. *Agardh*, and the like), seaweeds (e.g., kelp), a fungal cell (e.g., a yeast cell, a cell from a mushroom), an animal cell, a cell from an invertebrate animal (e.g., fruit fly, cnidarian, echinoderm, nematode, etc.), a cell from a vertebrate animal (e.g., fish, amphibian, reptile, bird, mammal), a cell from a mammal (e.g., a pig, a cow, a goat, a sheep, a rodent, a rat, a mouse, a non-human primate, a human, etc.), and etcetera. Sometimes a cell is not originating from a natural organism (e.g., a cell can be a synthetically made, sometimes termed an artificial cell).

The term "nucleotide," as used herein, generally refers to a base-sugar-phosphate combination. A nucleotide may comprise a synthetic nucleotide. A nucleotide may comprise a synthetic nucleotide analog. Nucleotides may be monomeric units of a nucleic acid sequence (e.g., deoxyribonucleic acid (DNA) and ribonucleic acid (RNA)). The term nucleotide may include ribonucleoside triphosphates adenosine triphosphate (ATP), uridine triphosphate (UTP), cytosine triphosphate (CTP), guanosine triphosphate (GTP) and deoxyribonucleoside triphosphates such as dATP, dCTP, dITP, dUTP, dGTP, dTTP, or derivatives thereof. Such derivatives may include, for example, [αS]dATP, 7-deaza-dGTP and 7-deaza-dATP, and nucleotide derivatives that confer nuclease resistance on the nucleic acid molecule containing them. The term nucleotide as used herein may refer to dideoxyribonucleoside triphosphates (ddNTPs) and their derivatives. Illustrative examples of dideoxyribonucleoside triphosphates may include, but are not limited to, ddATP, ddCTP, ddGTP, ddITP, and ddTTP. A nucleotide may be unlabeled or detectably labeled, such as using moieties comprising optically detectable moieties (e.g., fluorophores). Labeling may also be carried out with quantum dots. Detectable labels may include, for example, radioactive isotopes, fluorescent labels, chemiluminescent labels, bioluminescent labels and enzyme labels. Fluorescent labels of nucleotides may include but are not limited fluorescein, 5-carboxyfluorescein (FAM), 2'7'-dimethoxy-4'5-dichloro-6-carboxyfluorescein (JOE), rhodamine, 6-carboxyrhodamine (R6G), N,N,N',N'-tetramethyl-6-carboxyrhodamine (TAMRA), 6-carboxy-X-rhodamine (ROX), 4-(4'dimethyl-aminophenylazo) benzoic acid (DABCYL), Cascade Blue, Oregon Green, Texas Red, Cyanine and 5-(2'-aminoethyl) aminonaphthalene-1-sulfonic acid (EDANS). Specific examples of fluorescently labeled nucleotides can include [R6G]dUTP, [TAMRA]dUTP, [R110]dCTP, [R6G]dCTP, [TAMRA]dCTP, [JOE]ddATP, [R6G]ddATP, [FAM]ddCTP, [R110]ddCTP, [TAMRA]ddGTP, [ROX]ddTTP, [dR6G]ddATP, [dR110]ddCTP, [dTAMRA]ddGTP, and [dROX]ddTTP available from Perkin Elmer, Foster City, Calif.; FluoroLink DeoxyNucleotides, FluoroLink Cy3-dCTP, FluoroLink Cy5-dCTP, FluoroLink Fluor X-dCTP, FluoroLink Cy3-dUTP, and FluoroLink Cy5-dUTP available from Amersham, Arlington Heights, Ill.; Fluorescein-15-dATP, Fluorescein-12-dUTP, Tetramethyl-rodamine-6-dUTP, IR770-9-dATP, Fluorescein-12-ddUTP, Fluorescein-12-UTP, and Fluorescein-15-2'-dATP available from Boehringer Mannheim, Indianapolis, Ind.; and Chromosome Labeled Nucleotides, BODIPY-FL-14-UTP, BODIPY-FL-4-UTP, BODIPY-TMR-14-UTP, BODIPY-TMR-14-dUTP, BODIPY-TR-14-UTP, BODIPY-TR-14-dUTP, Cascade Blue-7-UTP, Cascade Blue-7-dUTP, fluorescein-12-UTP, fluorescein-12-dUTP, Oregon Green 488-5-dUTP, Rhodamine Green-5-UTP, Rhodamine Green-5-dUTP, tetramethylrhodamine-6-UTP, tetramethylrhodamine-6-dUTP, Texas Red-5-UTP, Texas Red-5-dUTP, and Texas Red-12-dUTP available from Molecular Probes, Eugene, Oreg. Nucleotides can also be labeled or marked by chemical modification. A chemically-modified single nucleotide can be biotin-dNTP. Some non-limiting examples of biotinylated dNTPs can include, biotin-dATP (e.g., bio-N6-ddATP, biotin-14-dATP), biotin-dCTP (e.g., biotin-11-dCTP, biotin-14-dCTP), and biotin-dUTP (e.g., biotin-11-dUTP, biotin-16-dUTP, biotin-20-dUTP).

The terms "polynucleotide," "oligonucleotide," and "nucleic acid" are used interchangeably to generally refer to a polymeric form of nucleotides of any length, either deoxyribonucleotides or ribonucleotides, or analogs thereof, either in single-, double-, or multi-stranded form. A polynucleotide may be exogenous or endogenous to a cell. A polynucleotide may exist in a cell-free environment. A polynucleotide may be a gene or fragment thereof. A polynucleotide may be DNA. A polynucleotide may be RNA. A polynucleotide may have any three-dimensional structure and may perform any function. A polynucleotide may comprise one or more analogs (e.g., altered backbone, sugar, or nucleobase). If present, modifications to the nucleotide structure may be imparted before or after assembly of the polymer. Some non-limiting examples of analogs include: 5-bromouracil, peptide nucleic acid, xeno nucleic acid, morpholinos, locked nucleic acids, glycol nucleic acids, threose nucleic acids, dideoxynucleotides, cordycepin, 7-deaza-GTP, fluorophores (e.g., rhodamine or fluorescein linked to the sugar), thiol containing nucleotides, biotin linked nucleotides, fluorescent base analogs, CpG islands, methyl-7-guanosine, methylated nucleotides, inosine, thiouridine, pseudourdine, dihydrouridine, queuosine, and wyosine. Non-limiting examples of polynucleotides include coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, cell-free polynucleotides including cell-free DNA (cfDNA) and cell-free RNA (cfRNA), nucleic acid probes, and primers. The sequence of nucleotides may be interrupted by non-nucleotide components.

The terms "transfection" or "transfected" generally refer to introduction of a nucleic acid into a cell by non-viral or viral-based methods. The nucleic acid molecules may be gene sequences encoding complete proteins or functional portions thereof. See, e.g., Sambrook et al., 1989, Molecular Cloning: A Laboratory Manual, 18.1-18.88.

The terms "peptide," "polypeptide," and "protein" are used interchangeably herein to generally refer to a polymer of at least two amino acid residues joined by peptide bond(s). This term does not connote a specific length of polymer, nor is it intended to imply or distinguish whether the peptide is produced using recombinant techniques, chemical or enzymatic synthesis, or is naturally occurring. The terms apply to naturally occurring amino acid polymers as well as amino acid polymers comprising at least one modified amino acid. In some cases, the polymer may be interrupted by non-amino acids. The terms include amino acid chains of any length, including full length proteins, and proteins with or without secondary and/or tertiary structure (e.g., domains). The terms also encompass an amino acid polymer that has been modified, for example, by disulfide bond formation, glycosylation, lipidation, acetylation, phosphorylation, oxidation, and any other manipulation such as conjugation with a labeling component. The terms "amino acid" and "amino acids," as used herein, generally refer to natural and non-natural amino acids, including, but not limited to, modified amino acids and amino acid analogues. Modified amino acids may include natural amino acids and non-natural amino acids, which have been chemically modified to include a group or a chemical moiety not naturally present on the amino acid. Amino acid analogues may refer to amino acid derivatives. The term "amino acid" includes both D-amino acids and L-amino acids.

As used herein, the "non-native" can generally refer to a nucleic acid or polypeptide sequence that is not found in a native nucleic acid or protein. Non-native may refer to affinity tags. Non-native may refer to fusions. Non-native may refer to a naturally occurring nucleic acid or polypeptide sequence that comprises mutations, insertions and/or deletions. A non-native sequence may exhibit and/or encode for an activity (e.g., enzymatic activity, methyltransferase activity, acetyltransferase activity, kinase activity, ubiquitinating activity, etc.) that may also be exhibited by the nucleic acid and/or polypeptide sequence to which the non-native sequence is fused. A non-native nucleic acid or polypeptide sequence may be linked to a naturally-occurring nucleic acid or polypeptide sequence (or a variant thereof) by genetic engineering to generate a chimeric nucleic acid and/or polypeptide sequence encoding a chimeric nucleic acid and/or polypeptide.

The term "promoter", as used herein, generally refers to the regulatory DNA region which controls transcription or expression of a gene and which may be located adjacent to or overlapping a nucleotide or region of nucleotides at which RNA transcription is initiated. A promoter may contain specific DNA sequences which bind protein factors, often referred to as transcription factors, which facilitate binding of RNA polymerase to the DNA leading to gene transcription. A 'basal promoter', also referred to as a 'core promoter', may generally refer to a promoter that contains all the basic necessary elements to promote transcriptional expression of an operably linked polynucleotide. Eukaryotic basal promoters typically, though not necessarily, contain a TATA-box and/or a CAAT box.

The term "expression", as used herein, generally refers to the process by which a nucleic acid sequence or a polynucleotide is transcribed from a DNA template (such as into mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

As used herein, "operably linked", "operable linkage", "operatively linked", or grammatical equivalents thereof generally refer to juxtaposition of genetic elements, e.g., a promoter, an enhancer, a polyadenylation sequence, etc., wherein the elements are in a relationship permitting them to operate in the expected manner. For instance, a regulatory element, which may comprise promoter and/or enhancer sequences, is operatively linked to a coding region if the regulatory element helps initiate transcription of the coding sequence. There may be intervening residues between the regulatory element and coding region so long as this functional relationship is maintained.

A "vector" as used herein, generally refers to a macromolecule or association of macromolecules that comprises or associates with a polynucleotide and which may be used to mediate delivery of the polynucleotide to a cell. Examples of vectors include plasmids, viral vectors, liposomes, and other gene delivery vehicles. The vector generally comprises genetic elements, e.g., regulatory elements, operatively linked to a gene to facilitate expression of the gene in a target.

As used herein, "an expression cassette" and "a nucleic acid cassette" are used interchangeably generally to refer to a combination of nucleic acid sequences or elements that are expressed together or are operably linked for expression. In some cases, an expression cassette refers to the combination of regulatory elements and a gene or genes to which they are operably linked for expression.

A "functional fragment" of a DNA or protein sequence generally refers to a fragment that retains a biological activity (either functional or structural) that is substantially similar to a biological activity of the full-length DNA or protein sequence. A biological activity of a DNA sequence may be its ability to influence expression in a manner known to be attributed to the full-length sequence.

As used herein, an "engineered" object generally indicates that the object has been modified by human intervention. According to non-limiting examples: a nucleic acid may be modified by changing its sequence to a sequence that does not occur in nature; a nucleic acid may be modified by ligating it to a nucleic acid that it does not associate with in nature such that the ligated product possesses a function not present in the original nucleic acid; an engineered nucleic acid may synthesized in vitro with a sequence that does not exist in nature; a protein may be modified by changing its amino acid sequence to a sequence that does not exist in nature; an engineered protein may acquire a new function or property. An "engineered" system comprises at least one engineered component.

As used herein, "synthetic" and "artificial" are used interchangeably to refer to a protein or a domain thereof that has low sequence identity (e.g., less than 50% sequence identity, less than 25% sequence identity, less than 10% sequence identity, less than 5% sequence identity, less than 1% sequence identity) to a naturally occurring human protein. For example, VPR and VP64 domains are synthetic transactivation domains.

The term "tracrRNA" or "tracr sequence", as used herein, can generally refer to a nucleic acid with at least about 5%, 10%, 20%, 30%, 40%, 50%, 60%, 70%, 80%, 90%, 95%, or 100% sequence identity and/or sequence similarity to a wild type exemplary tracrRNA sequence (e.g., a tracrRNA from *S. pyogenes S. aureus*, etc or SEQ ID NOs: 5476-5511). tracrRNA can refer to a nucleic acid with at most about 5%, 10%, 20%, 30%, 40%, 50%, 60%, 70%, 80%, 90%, or 100% sequence identity and/or sequence similarity to a wild type exemplary tracrRNA sequence (e.g., a tracrRNA from *S. pyogenes S. aureus*, etc). tracrRNA may refer to a modified form of a tracrRNA that can comprise a nucleotide change such as a deletion, insertion, or substitution, variant, mutation, or chimera. A tracrRNA may refer to a nucleic acid that can be at least about 60% identical to a wild type exemplary tracrRNA (e.g., a tracrRNA from *S. pyogenes S. aureus*, etc) sequence over a stretch of at least 6 contiguous nucleotides. For example, a tracrRNA sequence can be at least about 60% identical, at least about 65% identical, at least about 70% identical, at least about 75% identical, at least about 80% identical, at least about 85% identical, at least about 90% identical, at least about 95% identical, at least about 98% identical, at least about 99% identical, or 100% identical to a wild type exemplary tracrRNA (e.g., a tracrRNA from *S. pyogenes S. aureus*, etc) sequence over a stretch of at least 6 contiguous nucleotides. Type II tracrRNA sequences can be predicted on a genome sequence by identifying regions with complementarity to part of the repeat sequence in an adjacent CRISPR array.

As used herein, a "guide nucleic acid" can generally refer to a nucleic acid that may hybridize to another nucleic acid. A guide nucleic acid may be RNA. A guide nucleic acid may be DNA. The guide nucleic acid may be programmed to bind to a sequence of nucleic acid site-specifically. The nucleic acid to be targeted, or the target nucleic acid, may comprise nucleotides. The guide nucleic acid may comprise nucleotides. A portion of the target nucleic acid may be complementary to a portion of the guide nucleic acid. The strand of a double-stranded target polynucleotide that is complementary to and hybridizes with the guide nucleic acid may be called the complementary strand. The strand of the double-stranded target polynucleotide that is complementary to the complementary strand, and therefore may not be complementary to the guide nucleic acid may be called noncomplementary strand. A guide nucleic acid may comprise a polynucleotide chain and can be called a "single guide nucleic acid." A guide nucleic acid may comprise two polynucleotide chains and may be called a "double guide nucleic acid." If not otherwise specified, the term "guide nucleic acid" may be inclusive, referring to both single guide nucleic acids and double guide nucleic acids. A guide nucleic acid may comprise a segment that can be referred to as a "nucleic acid-targeting segment" or a "nucleic acid-targeting sequence." A nucleic acid-targeting segment may comprise a sub-segment that may be referred to as a "protein binding segment" or "protein binding sequence" or "Cas protein binding segment".

The term "sequence identity" or "percent identity" in the context of two or more nucleic acids or polypeptide sequences, generally refers to two (e.g., in a pairwise alignment) or more (e.g., in a multiple sequence alignment) sequences that are the same or have a specified percentage of amino acid residues or nucleotides that are the same, when compared and aligned for maximum correspondence over a local or global comparison window, as measured using a sequence comparison algorithm. Suitable sequence comparison algorithms for polypeptide sequences include, e.g., BLASTP using parameters of a wordlength (W) of 3, an expectation (E) of 10, and the BLOSUM62 scoring matrix setting gap costs at existence of 11, extension of 1, and using a conditional compositional score matrix adjustment for polypeptide sequences longer than 30 residues; BLASTP using parameters of a wordlength (W) of 2, an expectation (E) of 1000000, and the PAM30 scoring matrix setting gap costs at 9 to open gaps and 1 to extend gaps for sequences of less than 30 residues (these are the default parameters for BLASTP in the BLAST suite available at www.blast.ncbi.nlm.nih.gov); CLUSTALW with parameters of; the Smith-Waterman homology search algorithm with parameters of a match of 2, a mismatch of −1, and a gap of −1; MUSCLE with default parameters; MAFFT with parameters retree of 2 and maxiterations of 1000; Novafold with default parameters; HMMER hmmalign with default parameters.

Included in the current disclosure are variants of any of the enzyme described herein with one or more conservative amino acid substitutions. Such conservative substitutions can be made in the amino acid sequence of a polypeptide without disrupting the three-dimensional structure or function of the polypeptide. Conservative substitutions can be accomplished by substituting amino acids with similar hydrophobicity, polarity, and R chain length for one another. Additionally or alternatively, by comparing aligned sequences of homologous proteins from different species, conservative substitutions can be identified by locating amino acid residues that have been mutated between species (e.g. non-conserved residues) without altering the basic functions of the encoded proteins. Such conservatively substituted variants may include variants with at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of the endonuclease protein sequences described herein (e.g. MG1, MG2, MG3, MG4, MG6, MG7, MG14, MG15, MG16, MG18, MG21, MG22, or MG23 family endonucleases described herein). In some embodiments, such conservatively substituted variants are functional variants. Such functional variants can encompass sequences with substitutions such that the activity of critical active site residues of the endonuclease are not disrupted.

Conservative substitution tables providing functionally similar amino acids are available from a variety of references (see, for e.g., Creighton, Proteins: Structures and Molecular Properties (W H Freeman & Co.; 2nd edition (December 1993)). The following eight groups each contain amino acids that are conservative substitutions for one another:
1) Alanine (A), Glycine (G);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V);
6) Phenylalanine (F), Tyrosine (Y), Tryptophan (W);
7) Serine (S), Threonine (T); and
8) Cysteine (C), Methionine (M).

As used herein, the term "RuvC_III domain" generally refers to a third discontinuous segment of a RuvC endonuclease domain (the RuvC nuclease domain being comprised of three discontiguous segments, RuvC_I, RuvC_II, and RuvC_III). A RuvC domain or segments thereof can generally be identified by alignment to known domain sequences, structural alignment to proteins with annotated domains, or by comparison to Hidden Markov Models (HMMs) built based on known domain sequences (e.g., Pfam HMM PF18541 for RuvC_III).

As used herein, the term "HNH domain" generally refers to an endonuclease domain having characteristic histidine and asparagine residues. An HNH domain can generally be identified by alignment to known domain sequences, structural alignment to proteins with annotated domains, or by comparison to Hidden Markov Models (HMMs) built based on known domain sequences (e.g., Pfam HMM PF01844 for domain HNH).

Overview

The discovery of new Cas enzymes with unique functionality and structure may offer the potential to further disrupt deoxyribonucleic acid (DNA) editing technologies, improving speed, specificity, functionality, and ease of use. Relative to the predicted prevalence of Clustered Regularly Interspaced Short Palindromic Repeats (CRISPR) systems in microbes and the sheer diversity of microbial species, relatively few functionally characterized CRISPR/Cas enzymes exist in the literature. This is partly because a huge number of microbial species may not be readily cultivated in laboratory conditions. Metagenomic sequencing from natural environmental niches that represent large numbers of microbial species may offer the potential to drastically increase the number of new CRISPR/Cas systems known and speed the discovery of new oligonucleotide editing functionalities. A recent example of the fruitfulness of such an approach is demonstrated by the 2016 discovery of CasX/CasY CRISPR systems from metagenomic analysis of natural microbial communities.

CRISPR/Cas systems are RNA-directed nuclease complexes that have been described to function as an adaptive immune system in microbes. In their natural context, CRISPR/Cas systems occur in CRISPR (clustered regularly interspaced short palindromic repeats) operons or loci, which generally comprise two parts: (i) an array of short repetitive sequences (30-40 bp) separated by equally short spacer sequences, which encode the RNA-based targeting element; and (ii) ORFs encoding the Cas encoding the nuclease polypeptide directed by the RNA-based targeting element alongside accessory proteins/enzymes. Efficient nuclease targeting of a particular target nucleic acid sequence generally requires both (i) complementary hybridization between the first 6-8 nucleic acids of the target (the target seed) and the crRNA guide; and (ii) the presence of a protospacer-adjacent motif (PAM) sequence within a defined vicinity of the target seed (the PAM usually being a sequence not commonly represented within the host genome). Depending on the exact function and organization of the system, CRISPR-Cas systems are commonly organized into 2 classes, 5 types and 16 subtypes based on shared functional characteristics and evolutionary similarity.

Class I CRISPR-Cas systems have large, multisubunit effector complexes, and comprise Types I, III, and IV.

Type I CRISPR-Cas systems are considered of moderate complexity in terms of components. In Type I CRISPR-Cas systems, the array of RNA-targeting elements is transcribed as a long precursor crRNA (pre-crRNA) that is processed at repeat elements to liberate short, mature crRNAs that direct the nuclease complex to nucleic acid targets when they are followed by a suitable short consensus sequence called a protospacer-adjacent motif (PAM). This processing occurs via an endoribonuclease subunit (Cas6) of a large endonuclease complex called Cascade, which also comprises a nuclease (Cas3) protein component of the crRNA-directed nuclease complex. Cas I nucleases function primarily as DNA nucleases.

Type III CRISPR systems may be characterized by the presence of a central nuclease, known as Cas10, alongside a repeat-associated mysterious protein (RAMP) that comprises Csm or Cmr protein subunits. Like in Type I systems, the mature crRNA is processed from a pre-crRNA using a Cas6-like enzyme. Unlike type I and II systems, type III systems appear to target and cleave DNA-RNA duplexes (such as DNA strands being used as templates for an RNA polymerase).

Type IV CRISPR-Cas systems possess an effector complex that consists of a highly reduced large subunit nuclease (csf1), two genes for RAMP proteins of the Cas5 (csf3) and Cas7 (csf2) groups, and, in some cases, a gene for a predicted small subunit; such systems are commonly found on endogenous plasmids.

Class II CRISPR-Cas systems generally have single-polypeptide multidomain nuclease effectors, and comprise Types II, V and VI.

Type II CRISPR-Cas systems are considered the simplest in terms of components. In Type II CRISPR-Cas systems, the processing of the CRISPR array into mature crRNAs does not require the presence of a special endonuclease subunit, but rather a small trans-encoded crRNA (tracrRNA) with a region complementary to the array repeat sequence; the tracrRNA interacts with both its corresponding effector nuclease (e.g. Cas9) and the repeat sequence to form a precursor dsRNA structure, which is cleaved by endogenous RNAse III to generate a mature effector enzyme loaded with both tracrRNA and crRNA. Cas II nucleases are known as DNA nucleases. Type 2 effectors generally exhibit a structure consisting of a RuvC-like endonuclease domain that adopts the RNase H fold with an unrelated HNH nuclease domain inserted within the folds of the RuvC-like nuclease domain. The RuvC-like domain is responsible for the cleavage of the target (e.g., crRNA complementary) DNA strand, while the HNH domain is responsible for cleavage of the displaced DNA strand.

Type V CRISPR-Cas systems are characterized by a nuclease effector (e.g. Cas12) structure similar to that of Type II effectors, comprising a RuvC-like domain. Similar to Type II, most (but not all) Type V CRISPR systems use a tracrRNA to process pre-crRNAs into mature crRNAs; however, unlike Type II systems which requires RNAse III to cleave the pre-crRNA into multiple crRNAs, type V systems are capable of using the effector nuclease itself to cleave pre-crRNAs. Like Type-II CRISPR-Cas systems, Type V CRISPR-Cas systems are again known as DNA nucleases. Unlike Type II CRISPR-Cas systems, some Type V enzymes (e.g., Cas12a) appear to have a robust single-stranded nonspecific deoxyribonuclease activity that is activated by the first crRNA directed cleavage of a double-stranded target sequence.

Type VI CRIPSR-Cas systems have RNA-guided RNA endonucleases. Instead of RuvC-like domains, the single polypeptide effector of Type VI systems (e.g. Cas13) comprises two HEPN ribonuclease domains. Differing from both Type II and V systems, Type VI systems also appear to not need a tracrRNA for processing of pre-crRNA into crRNA. Similar to type V systems, however, some Type VI systems (e.g., C2C2) appear to possess robust single-stranded non-specific nuclease (ribonuclease) activity activated by the first crRNA directed cleavage of a target RNA.

Because of their simpler architecture, Class II CRISPR-Cas have been most widely adopted for engineering and development as designer nuclease/genome editing applications.

Figure 2:
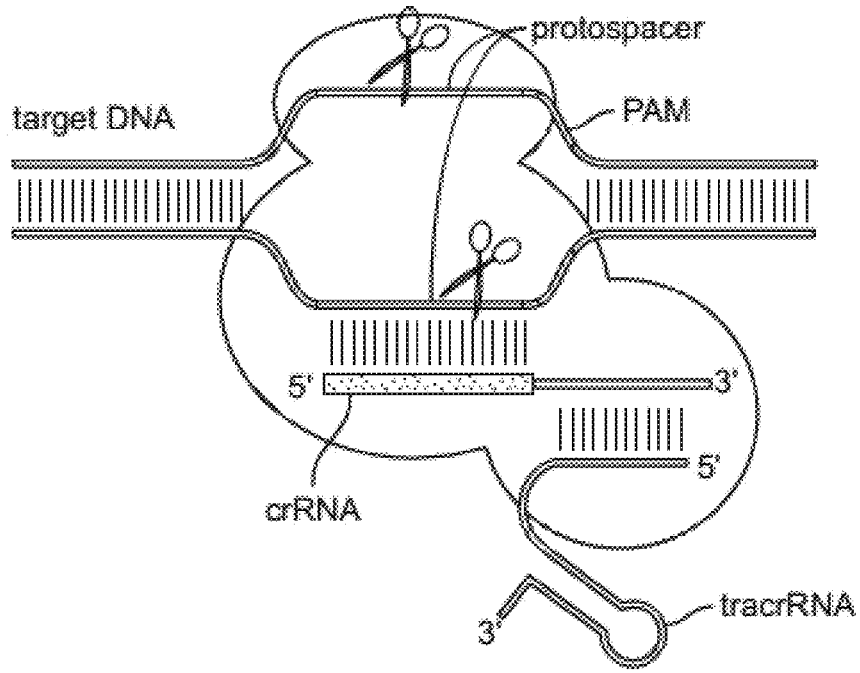
FIG. 2 depicts the architecture of a natural Class2/Type II crRNA/tracrRNA pair, compared to a hybrid sgRNA wherein both are joined.
Figure 2:
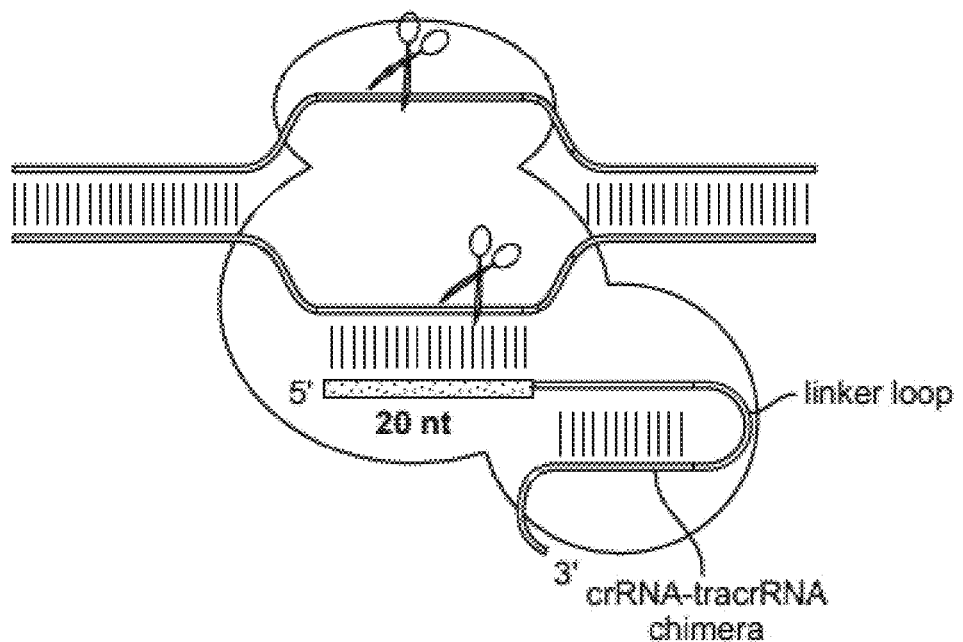
Figure 3:
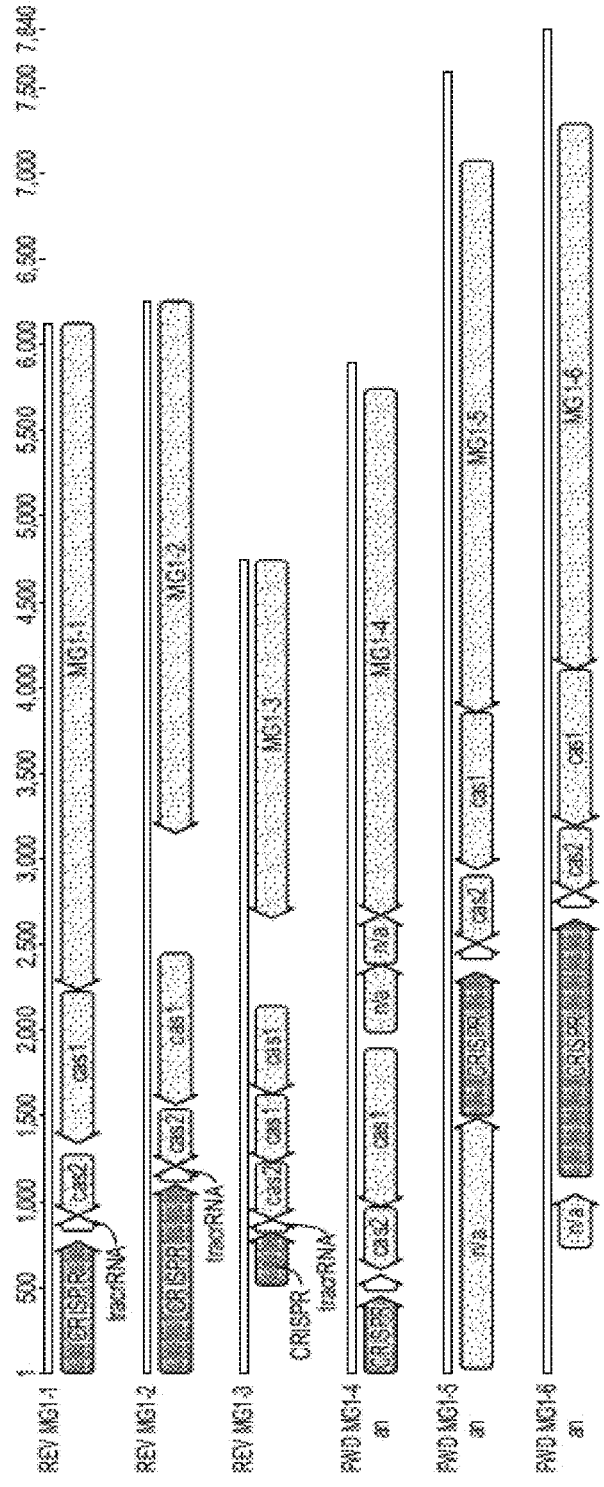
FIG. 3 depicts schematics showing organization of CRISPR loci encoding enzymes from the MG1 family.
Figure 4:
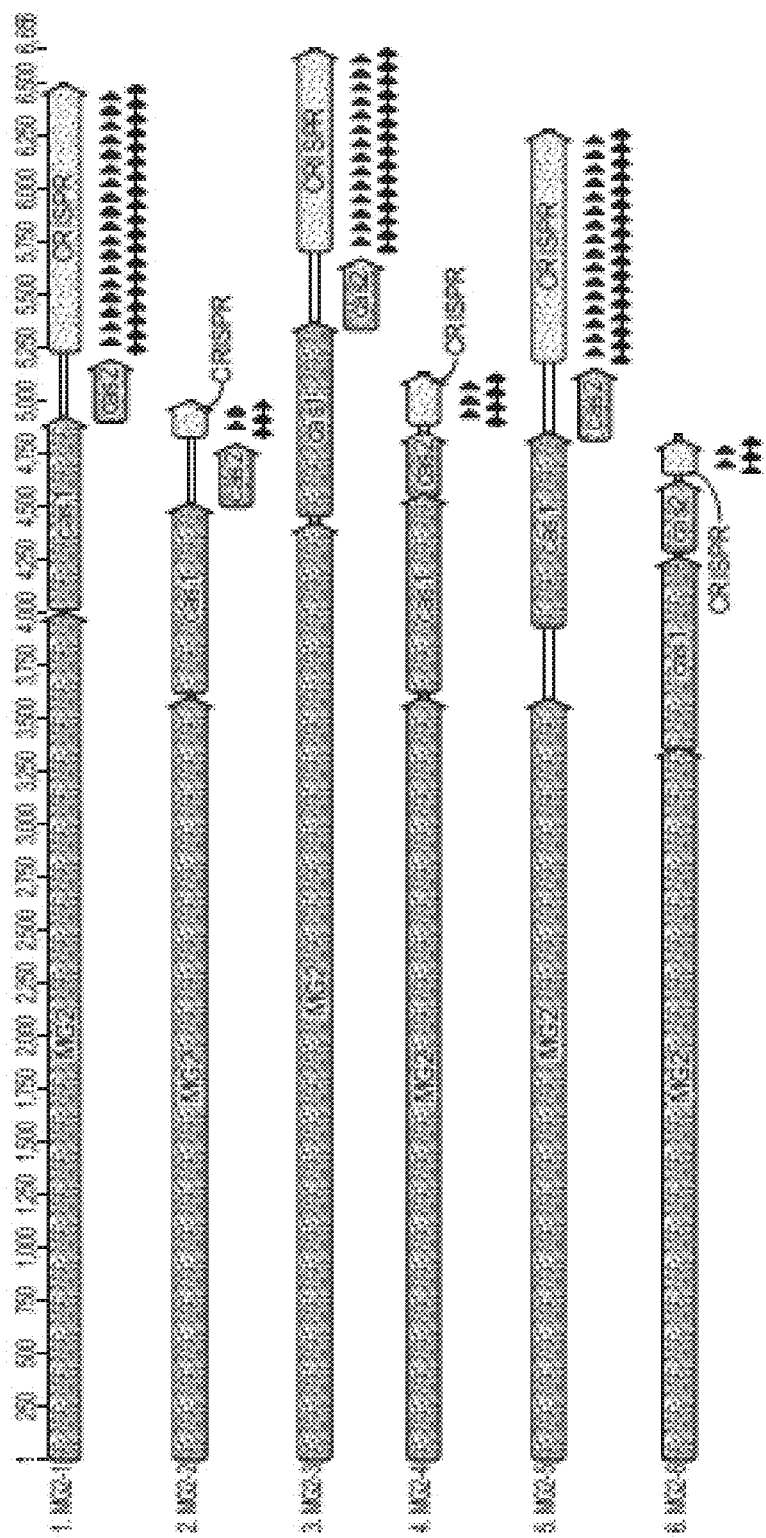
FIG. 4 depicts schematics showing organization of CRISPR loci encoding enzymes from the MG2 family.
Figure 5:
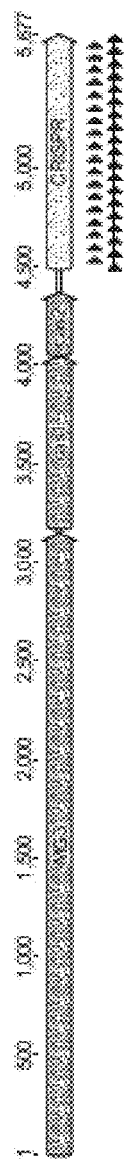
FIG. 5 depicts schematics showing organization of CRISPR loci encoding enzymes from the MG3 family.

One of the early adaptations of such a system for in vitro use can be found in Jinek et al. (Science. 2012 Aug. 17; 337(6096):816-21, which is entirely incorporated herein by reference). The Jinek study first described a system that involved (i) recombinantly-expressed, purified full-length Cas9 (e.g., a Class II, Type II Cas enzyme) isolated from *S. pyogenes* SF370, (ii) purified mature ~42 nt crRNA bearing a ~20 nt 5' sequence complementary to the target DNA sequence desired to be cleaved followed by a 3' tracr-binding sequence (the whole crRNA being in vitro transcribed from a synthetic DNA template carrying a T7 promoter sequence); (iii) purified tracrRNA in vitro transcribed from a synthetic DNA template carrying a T7 promoter sequence, and (iv) Mg$^{2+}$. Jinek later described an improved, engineered system wherein the crRNA of (ii) is joined to the 5' end of (iii) by a linker (e.g., GAAA) to form a single fused synthetic guide RNA (sgRNA) capable of directing Cas9 to a target by itself (compare top and bottom panel of FIG. 2).

Mali et al. (Science. 2013 Feb. 15; 339(6121): 823-826.), which is entirely incorporated herein by reference, later adapted this system for use in mammalian cells by providing DNA vectors encoding (i) an ORF encoding codon-optimized Cas9 (e.g., a Class II, Type II Cas enzyme) under a suitable mammalian promoter with a C-terminal nuclear localization sequence (e.g., SV40 NLS) and a suitable polyadenylation signal (e.g., TK pA signal); and (ii) an ORF encoding an sgRNA (having a 5' sequence beginning with G followed by 20 nt of a complementary targeting nucleic acid sequence joined to a 3' tracr-binding sequence, a linker, and the tracrRNA sequence) under a suitable Polymerase III promoter (e.g., the U6 promoter).

MG1 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 1827-2140. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 1827-2140. In some cases, the endonuclease may comprise a RuvC_III domain, wherein the substantially identical to any one of SEQ ID NOs: 1827-2140. The endonuclease may comprise a RuvC_III domain having at least about 70% sequence identity to any one of SEQ ID NOs: 1827-1831. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 1827-1831. In some cases, the endonuclease may comprise a RuvC_III domain substantially identical to any one of SEQ ID NOs: 1827-1831. In some cases, the endonuclease may comprise a RuvC_III domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to SEQ ID NO: 1827. In some cases, the endonuclease may comprise a RuvC_III domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to SEQ ID NO: 1828.

In some cases, the endonuclease may comprise a RuvC_III domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to SEQ ID NO: 1829. In some cases, the endonuclease may comprise a RuvC_III domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to SEQ ID NO: 1830. In some cases, the endonuclease may comprise a RuvC_III domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to SEQ ID NO: 1831.

The endonuclease may comprise an HNH domain having at least about 70% identity to any one of SEQ ID NOs: 3638-3955. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3638-3955. The endonuclease may comprise an HNH domain substantially identical to any one of SEQ ID NOs: 3638-3955. The endonuclease may comprise an HNH domain having at least about 70% identity to any one of SEQ ID NOs: 3638-3955. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3638-3955. The endonuclease may comprise an HNH domain substantially identical to any one of SEQ ID NOs: 3638-3955. The endonuclease may comprise an HNH domain having at least about 70% identity to any one of SEQ ID NOs: 3638-3641. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3638-3641. The endonuclease may comprise an HNH domain substantially identical to any one of SEQ ID NOs: 3638-3641. The endonuclease may comprise an HNH domain having at least about 70% identity to any one of SEQ ID NOs: 3638. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3638. The endonuclease may comprise an HNH domain substantially identical to any one of SEQ ID NOs: 3638. The endonuclease may comprise an HNH domain having at least about 70% identity to any one of SEQ ID NOs: 3639. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3639. The endonuclease may comprise an HNH domain substantially identical to any one of SEQ ID NOs: 3639. The endonuclease may comprise an HNH domain having at least about 70% identity to any one of SEQ ID NOs: 3640. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3640. The endonuclease may comprise an HNH domain substantially identical to any one of SEQ ID NOs: 3640. The endonuclease may comprise an HNH domain having at least about 70% identity to any one of SEQ ID NOs: 3641. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3641. The endonuclease may comprise an HNH domain substantially identical to any one of SEQ ID NOs: 3641.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1-6 or 9-319. In some cases, the endonuclease may be substantially identical to any one of SEQ ID NOs: 1-6 or 9-319. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs:1-4. In some cases, the endonuclease may be substantially identical to any one of SEQ ID NOs: 1-4. In some cases, the endonuclease may comprise a peptide motif substantially identical to any one of SEQ ID NOs: 5615, 5616, or 5617.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 1-6 or 9-319, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1-319. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 below, or a combination thereof:

TABLE 1

Example NLS Sequences that can be used with Cas Effectors According to the Disclosure

| Source | NLS amino acid sequence | SEQ ID NO: |
| --- | --- | --- |
| SV40 | PKKKRKV | 5597 |
| nucleoplasmin bipartite NLS | KRPAATKKAGQAKKKK | 5598 |
| c-myc NLS | PAAKRVKLD | 5599 |
| c-myc NLS | RQRRNELKRSP | 5600 |
| hRNPA1 M9 NLS | NQSSNFGPMKGGNFGGRSSGPYGGGGQYFAKPRNQGGY | 5601 |
| Importin-alpha IBB domain | RMRIZFKNKGKDTAELRRRRVEVSVELRKAKKDEQILKRRNV | 5602 |
| Myoma T protein | VSRKRPRP | 5603 |
| Myoma T protein | PPKKARED | 5604 |
| p53 | PQPKKKPL | 5605 |
| mouse c-abl IV | SALIKKKKKMAP | 5606 |
| influenza virus NS1 | DRLRR | 5607 |
| influenza virus NS1 | PKQKKRK | 5608 |
| Hepatitis virus delta antigen | RKLKKKIKKL | 5609 |
| mouse Mx1 protein | REKKKFLKRR | 5610 |

TABLE 1-continued

Example NLS Sequences that can be used with Cas Effectors According to the Disclosure

| Source | NLS amino acid sequence | SEQ ID NO: |
|---|---|---|
| human poly(ADP-ribose) polymerase | KRKGDEVDGVDEVAKKKSKK | 5611 |
| steroid hormone receptor (human) glucocorticoid | RKCLQAGMNLEARKTKK | 5612 |

In some cases, the endonuclease may be recombinant (e.g., cloned, expressed, and purified by a suitable method such as expression in E. coli followed by epitope-tag purification). In some cases, the endonuclease may be derived from a bacterium with a 16S rRNA gene having at least about 90% identity to any one of SEQ ID NOs: 5592-5595. The endonuclease may be derived from a species having a 16S rRNA gene at least about 80%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% identity to any one of SEQ ID NOs: 5592-5595. The endonuclease may be derived from a species having a 16S rRNA gene substantially identical to any one of SEQ ID NOs: 5592-5595. The endonuclease may be derived from a bacterium belonging to the Phylum Verrucomicrobia or the Phylum Candidatus Peregrinibacteria.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of any one of SEQ ID NOs: 5476-5489. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of any one of SEQ ID NOs: 5476-5489. In some cases, the tracrRNA may be substantially identical to at least about 60-100 (e.g., at least about 60, at least about 65, at least about 70, at least about 75, at least about 80, at least about 85, or at least about 90) consecutive nucleotides of any one of SEQ ID NOs: 5476-5489. The tracrRNA may comprise any of SEQ ID NOs: 5476-5489.

In some cases, the at least one engineered synthetic guide ribonucleic acid (sgRNA) capable of forming a complex with the endonuclease may comprise a sequence having at least about 80% identity to any one of SEQ ID NOs: 5461-5464. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to any one of SEQ ID NOs: 5461-5464. The sgRNA may comprise a sequence substantially identical to any one of SEQ ID NOs: 5461-5464.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus, may modify the target nucleic acid locus. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 1827-2140. The deoxyribonucleic acid (DNA) containing an open reading frame encoding said endonuclease may comprise a sequence substantially identical to any of SEQ ID NOs: 5572-5575 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 5572-5575. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

In some cases, the present disclosure may provide for an expression cassette comprising the system disclosed herein, or the nucleic acid described herein. In some cases, the expression cassette or nucleic acid may be supplied as a vector. In some cases, the expression cassette, nucleic acid, or vector may be supplied in a cell. In some cases, the cell is a cell of a bacterium with a 16S rRNA gene having at least about 90% (e.g., at least about 99%) identity to any one of SEQ ID NOs: 5592-5595.

MG2 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least 70% sequence identity to any one of SEQ ID NOs: 2141-2241. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2141-2241. In some cases, the endonuclease may comprise a RuvC_III domain, wherein the substantially identical to any one of SEQ ID NOs: 2141-2142. The endonuclease may comprise a RuvC_III domain having at least about 70% sequence identity to any one of SEQ ID NOs: 2141-2142. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2141-2142. In some cases, the endonuclease may comprise a RuvC_III domain substantially identical to any one of SEQ ID NOs: 2141-2142.

The endonuclease may comprise an HNH domain having at least about 70% identity to any one of SEQ ID NOs: 3955-4055. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3955-4055. The endonuclease may comprise an HNH domain substantially identical to any one of SEQ ID NOs: 3955-4055. The endonuclease may comprise an HNH domain having at least about 70% identity to any one of SEQ ID NOs: 3955-3956. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3955-3956. The endonuclease may comprise an HNH domain substantially identical to any one of SEQ ID NOs: 3955-3956.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 320-420. In some cases, the endonuclease may be substantially identical to any one of SEQ ID NOs: 320-420. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs:320-321. In some cases, the endonuclease may be substantially identical to any one of SEQ ID NOs: 320-321.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 320-420, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 320-420. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of any one of SEQ ID NOs: 5490-5494. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of any one of SEQ ID NOs: 5490-5494. In some cases, the tracrRNA may be substantially identical to at least about 60-100 (e.g., at least about 60, at least about 65, at least about 70, at least about 75, at least about 80, at least about 85, or at least about 90) consecutive nucleotides of any one of SEQ ID NOs: 5490-5494. The tracrRNA may comprise any of SEQ ID NOs: 5490-5494.

In some cases, the at least one engineered synthetic guide ribonucleic acid (sgRNA) capable of forming a complex with the endonuclease may comprise a sequence having at least about 80% identity to SEQ ID NO: 5465. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5465. The sgRNA may comprise a sequence substantially identical to SEQ ID NO: 5465.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs:

2141-2241. The deoxyribonucleic acid (DNA) containing an open reading frame encoding said endonuclease may comprise a sequence substantially identical to any of SEQ ID NOs: 5576-5577 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 5576-5577. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG3 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2242-2251. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2242-2251. In some cases, the endonuclease may comprise a RuvC_III domain, wherein the substantially identical to any one of SEQ ID NOs: 2242-2251. The endonuclease may comprise a RuvC_III domain having at least about 70% sequence identity to any one of SEQ ID NOs: 2242-2244. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2242-2244. In some cases, the endonuclease may comprise a RuvC_III domain substantially identical to any one of SEQ ID NOs: 2242-2244.

The endonuclease may comprise an HNH domain having at least about 70% identity to any one of SEQ ID NOs: 4056-4066. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4056-4066. The endonuclease may comprise an HNH domain substantially identical to any one of SEQ ID NOs: 4056-4066. The endonuclease may comprise an HNH domain having at least about 70% identity to any one of SEQ ID NOs: 4056-4058. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4056-4058. The endonuclease may comprise an HNH domain substantially identical to any one of SEQ ID NOs: 4056-4058.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 421-431. In some cases, the endonuclease may be substantially identical to any one of SEQ ID NOs: 421-431. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs:421-423. In some cases, the endonuclease may be substantially identical to any one of SEQ ID NOs: 421-423.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 421-431, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 421-431. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of any one of SEQ ID NOs: 5495-5502. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of any one of SEQ ID NOs: 5495-5502. In some cases, the tracrRNA may be substantially identical to at least about 60-100 (e.g., at least about 60, at least about 65, at least about 70, at least about 75, at least about 80, at least about 85, or at least about 90) consecutive nucleotides of any one of SEQ ID NOs: 5495-5502. The tracrRNA may comprise any of SEQ ID NOs: 5495-5502.

In some cases, the at least one engineered synthetic guide ribonucleic acid (sgRNA) capable of forming a complex with the endonuclease may comprise a sequence having at least about 80% identity to any one of SEQ ID NOs: 5466-5467. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to any one of SEQ ID NOs: 5466-5467. The sgRNA may comprise a sequence substantially identical to any one of SEQ ID NOs: 5466-5467.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2242-2251. The deoxyribonucleic acid (DNA) containing an open reading frame encoding said endonuclease may comprise a sequence substantially identical to any of SEQ ID NOs: 5578-5580 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 5578-5580. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG4 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2253-2481. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2253-2481. In some cases, the endonuclease may comprise a RuvC_III domain, wherein the substantially identical to any one of SEQ ID NOs: 2253-2481. The endonuclease may comprise a RuvC_III domain having at least about 70% sequence identity to any one of SEQ ID NOs: 2253-2481. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2253-2481. In some cases, the endonuclease may comprise a RuvC_III domain substantially identical to any one of SEQ ID NOs: 2253-2481.

The endonuclease may comprise an HNH domain having at least about 70% identity to any one of SEQ ID NOs: 4067-4295. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4067-4295. The endonuclease may comprise an HNH domain substantially identical to any one of SEQ ID NOs: 4067-4295. The endonuclease may comprise an HNH domain having at least about 70% identity to any one of SEQ ID NOs: 4067-4295. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4067-4295. The endonuclease may comprise an HNH domain substantially identical to any one of SEQ ID NOs: 4067-4295.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 432-660. In some cases, the endonuclease may be substantially identical to any one of SEQ ID NOs: 432-660. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 432-660. In some cases, the endonuclease may be substantially identical to any one of SEQ ID NOs: 432-660.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 432-660, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 432-660. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5503. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5503. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5503. The tracrRNA may comprise SEQ ID NO: 5503.

In some cases, the at least one engineered synthetic guide ribonucleic acid (sgRNA) capable of forming a complex with the endonuclease may comprise a sequence having at least about 80% identity to SEQ ID NO: 5468. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5468. The sgRNA may comprise a sequence substantially identical to SEQ ID NO: 5468.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2253-2481. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG6 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2482-2489. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2482-2489. In some cases, the endonuclease may comprise a RuvC_III domain, wherein the substantially identical to any one of SEQ ID NOs: 2482-2489.

The endonuclease may comprise an HNH domain having at least about 70% identity to any one of SEQ ID NOs: 4296-4303. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4296-4303. The endonuclease may comprise an HNH domain substantially identical to any one of SEQ ID NOs: 4056-4066.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 661-668. In some cases, the endonuclease may be substantially identical to any one of SEQ ID NOs: 661-668.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 661-668, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 661-668. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence.

In some cases, the system above may comprise two different guide RNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2482-2489. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG7 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2490-2498. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2490-2498. In some cases, the endonuclease may comprise a RuvC_III domain, wherein the substantially identical to any one of SEQ ID NOs: 2490-2498. The endonuclease may comprise a RuvC_III domain having at least about 70% sequence identity to any one of SEQ ID NOs: 2490-2498. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2490-2498. In some cases, the endonuclease may comprise a RuvC_III domain substantially identical to any one of SEQ ID NOs: 2490-2498.

The endonuclease may comprise an HNH domain having at least about 70% identity to any one of SEQ ID NOs: 4304-4312. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4304-4312. The endonuclease may comprise an HNH domain substantially identical to any one of SEQ ID NOs: 4304-4312. The endonuclease may comprise an HNH domain having at least about 70% identity to any one of SEQ ID NOs: 4304-4312. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4304-4312. The endonuclease may comprise an HNH domain substantially identical to any one of SEQ ID NOs: 4304-4312.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 669-677. In some cases, the endonuclease may be substantially identical to any one of SEQ ID NOs: 669-677. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 669-677. In some cases, the endonuclease may be substantially identical to any one of SEQ ID NOs: 669-677.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 669-677, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 669-677. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5504. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5504. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5504. The tracrRNA may comprise SEQ ID NO: 5504.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2490-2498. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG14 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2499-2750. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2499-2750. In some cases, the endonuclease may comprise a RuvC_III domain, wherein the substantially identical to any one of SEQ ID NOs: 2499-2750. The endonuclease may comprise a RuvC_III domain having at least about 70% sequence identity to any one of SEQ ID NOs: 2499-2750. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2499-2750. In some cases, the endonuclease may comprise a RuvC_III domain substantially identical to any one of SEQ ID NOs: 2499-2750.

The endonuclease may comprise an HNH domain having at least about 70% identity to any one of SEQ ID NOs: 4313-4564. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4313-4564. The endonuclease may comprise an HNH domain substantially identical to any one of SEQ ID NOs: 4313-4564. The endonuclease may comprise an HNH domain having at least about 70% identity to any one of SEQ ID NOs: 4313-4564. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4067-4295. The endonuclease may comprise an HNH domain substantially identical to any one of SEQ ID NOs: 4313-4564.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 678-929. In some cases, the endonuclease may be substantially identical to any one of SEQ ID NOs: 678-929. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 678-929. In some cases, the endonuclease may be substantially identical to any one of SEQ ID NOs: 678-929.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 678-929, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 678-929. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5505. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5505. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5505. The tracrRNA may comprise SEQ ID NO: 5505.

In some cases, the at least one engineered synthetic guide ribonucleic acid (sgRNA) capable of forming a complex with the endonuclease may comprise a sequence having at least about 80% identity to SEQ ID NO: 5469. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5469. The sgRNA may comprise a sequence substantially identical to SEQ ID NO: 5469.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2499-2750. The deoxyribonucleic acid (DNA) containing an open reading frame encoding said endonuclease may comprise a sequence substantially identical to SEQ ID NO: 5581 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NO: 5581. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG15 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2751-2913. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2751-2913. In some cases, the endonuclease may comprise a RuvC_III domain, wherein the substantially identical to any one of SEQ ID NOs: 2751-2913. The endonuclease may comprise a RuvC_III domain having at least about 70% sequence identity to any one of SEQ ID NOs: 2751-2913. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2751-2913. In some cases, the endonuclease may comprise a RuvC_III domain substantially identical to any one of SEQ ID NOs: 2751-2913.

The endonuclease may comprise an HNH domain having at least about 70% identity to any one of SEQ ID NOs: 4565-4727. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4565-4727. The endonuclease may comprise an HNH domain substantially identical to any one of SEQ ID NOs: 4565-4727. The endonuclease may comprise an HNH domain having at least about 70% identity to any one of SEQ ID NOs: 4565-4727. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4565-4727. The endonuclease may comprise an HNH domain substantially identical to any one of SEQ ID NOs: 4565-4727.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 930-1092. In some cases, the endonuclease may be substantially identical to any one of SEQ ID NOs: 930-1092. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 930-1092. In some cases, the endonuclease may be substantially identical to any one of SEQ ID NOs: 930-1092.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 930-1092, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 930-1092. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5506. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5506. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5506. The tracrRNA may comprise SEQ ID NO: 5506.

In some cases, the at least one engineered synthetic guide ribonucleic acid (sgRNA) capable of forming a complex with the endonuclease may comprise a sequence having at least about 80% identity to SEQ ID NO: 5470. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5470. The sgRNA may comprise a sequence substantially identical to SEQ ID NO: 5470.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2751-2913. The deoxyribonucleic acid (DNA) containing an open reading frame encoding said endonuclease may comprise a sequence substantially identical to SEQ ID NO: 5582 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NO: 5582. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG16 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2914-3174. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2914-3174. In some cases, the endonuclease may comprise a RuvC_III domain, wherein the substantially identical to any one of SEQ ID NOs: 2914-3174. The endonuclease may comprise a RuvC_III domain having at least about 70% sequence identity to any one of SEQ ID NOs: 2914-3174. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2914-3174. In some cases, the endonuclease may comprise a RuvC_III domain substantially identical to any one of SEQ ID NOs: 2914-3174.

The endonuclease may comprise an HNH domain having at least about 70% identity to any one of SEQ ID NOs: 4728-4988. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4728-4988. The endonuclease may comprise an HNH domain substantially identical to any one of SEQ ID NOs: 4728-4988. The endonuclease may comprise an HNH domain having at least about 70% identity to any one of SEQ ID NOs: 4728-4988. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4728-4988. The endonuclease may comprise an HNH domain substantially identical to any one of SEQ ID NOs: 4728-4988.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1093-1353. In some cases, the endonuclease may be substantially identical to any one of SEQ ID NOs: 1093-1353. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1093-1353. In some cases, the endonuclease may be substantially identical to any one of SEQ ID NOs: 1093-1353.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 1093-1353, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1093-1353. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5507. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5507. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5507. The tracrRNA may comprise SEQ ID NO: 5507.

In some cases, the at least one engineered synthetic guide ribonucleic acid (sgRNA) capable of forming a complex with the endonuclease may comprise a sequence having at least about 80% identity to SEQ ID NO: 5471. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5471. The sgRNA may comprise a sequence substantially identical to SEQ ID NO: 5471.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2914-3174. The deoxyribonucleic acid (DNA) containing an open reading frame encoding said endonuclease may comprise a sequence substantially identical to SEQ ID NO: 5583 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NO: 5583. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG18 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 3175-3300. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3175-3300. In some cases, the endonuclease may comprise a RuvC_III domain, wherein the substantially identical to any one of SEQ ID NOs: 3175-3300. The endonuclease may comprise a RuvC_III domain having at least about 70% sequence identity to any one of SEQ ID NOs: 3175-3300. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3175-3300. In some cases, the endonuclease may comprise a RuvC_III domain substantially identical to any one of SEQ ID NOs: 3175-3300.

The endonuclease may comprise an HNH domain having at least about 70% identity to any one of SEQ ID NOs: 4989-5146. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4989-5146. The endonuclease may comprise an HNH domain substantially identical to any one of SEQ ID NOs: 4989-5146. The endonuclease may comprise an HNH domain having at least about 70% identity to any one of SEQ ID NOs: 4989-5146. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4989-5146. The endonuclease may comprise an HNH domain substantially identical to any one of SEQ ID NOs: 4989-5146.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1354-1511. In some cases, the endonuclease may be substantially identical to any one of SEQ ID NOs: 1354-1511. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1354-1511. In some cases, the endonuclease may be substantially identical to any one of SEQ ID NOs: 1354-1511.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 1354-1511, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1354-1511. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5508. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5508. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5508. The tracrRNA may comprise SEQ ID NO: 5508.

In some cases, the at least one engineered synthetic guide ribonucleic acid (sgRNA) capable of forming a complex with the endonuclease may comprise a sequence having at least about 80% identity to SEQ ID NO: 5472. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5472. The sgRNA may comprise a sequence substantially identical to SEQ ID NO: 5472.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 3175-3300. The deoxyribonucleic acid (DNA) containing an open reading frame encoding said endonuclease may comprise a sequence substantially identical to SEQ ID NOs: 5584 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NOs: 5584. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG21 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 3331-3474. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3331-3474. In some cases, the endonuclease may comprise a RuvC_III domain, wherein the substantially identical to any one of SEQ ID NOs: 3331-3474. The endonuclease may comprise a RuvC_III domain having at least about 70% sequence identity to any one of SEQ ID NOs: 3331-3474. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3331-3474. In some cases, the endonuclease may comprise a RuvC_III domain substantially identical to any one of SEQ ID NOs: 3331-3474.

The endonuclease may comprise an HNH domain having at least about 70% identity to any one of SEQ ID NOs: 5147-5290. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5147-5290. The endonuclease may comprise an HNH domain substantially identical to any one of SEQ ID NOs: 5147-5290. The endonuclease may comprise an HNH domain having at least about 70% identity to any one of SEQ ID NOs: 5147-5290. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5147-5290. The endonuclease may comprise an HNH domain substantially identical to any one of SEQ ID NOs: 5147-5290.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1512-1655. In some cases, the endonuclease may be substantially identical to any one of SEQ ID NOs: 1512-1655. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1512-1655. In some cases, the endonuclease may be substantially identical to any one of SEQ ID NOs: 1512-1655.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 1512-1655, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1512-1655. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5509. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5509. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5509. The tracrRNA may comprise SEQ ID NO: 5509.

In some cases, the at least one engineered synthetic guide ribonucleic acid (sgRNA) capable of forming a complex with the endonuclease may comprise a sequence having at least about 80% identity to SEQ ID NO: 5473. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5473. The sgRNA may comprise a sequence substantially identical to SEQ ID NO: 5473.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 3331-3474. The deoxyribonucleic acid (DNA) containing an open reading frame encoding said endonuclease may comprise a sequence substantially identical to SEQ ID NOs: 5585 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NOs: 5585. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG22 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 3475-3568. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3475-3568. In some cases, the endonuclease may comprise a RuvC_III domain, wherein the substantially identical to any one of SEQ ID NOs: 3475-3568. The endonuclease may comprise a RuvC_III domain having at least about 70% sequence identity to any one of SEQ ID NOs: 3475-3568. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3475-3568. In some cases, the endonuclease may comprise a RuvC_III domain substantially identical to any one of SEQ ID NOs: 3475-3568.

The endonuclease may comprise an HNH domain having at least about 70% identity to any one of SEQ ID NOs: 5291-5389. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5291-5389. The endonuclease may comprise an HNH domain substantially identical to any one of SEQ ID NOs: 5291-5389. The endonuclease may comprise an HNH domain having at least about 70% identity to any one of SEQ ID NOs: 5291-5389. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5291-5389. The endonuclease may comprise an HNH domain substantially identical to any one of SEQ ID NOs: 5291-5389.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1656-1755. In some cases, the endonuclease may be substantially identical to any one of SEQ ID NOs: 1656-1755. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1656-1755. In some cases, the endonuclease may be substantially identical to any one of SEQ ID NOs: 1656-1755.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 432-660, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1656-1755. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5510. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5510. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5510. The tracrRNA may comprise SEQ ID NO: 5510.

In some cases, the at least one engineered synthetic guide ribonucleic acid (sgRNA) capable of forming a complex with the endonuclease may comprise a sequence having at least about 80% identity to SEQ ID NO: 5474. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5474. The sgRNA may comprise a sequence substantially identical to SEQ ID NO: 5474.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 3475-3568. The deoxyribonucleic acid (DNA) containing an open reading frame encoding said endonuclease may comprise a sequence substantially identical to SEQ ID NOs: 5586 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NOs: 5586. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG23 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 3569-3637. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3569-3637. In some cases, the endonuclease may comprise a RuvC_III domain, wherein the substantially identical to any one of SEQ ID NOs: 3569-3637. The endonuclease may comprise a RuvC_III domain having at least about 70% sequence identity to any one of SEQ ID NOs: 3569-3637. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3569-3637. In some cases, the endonuclease may comprise a RuvC_III domain substantially identical to any one of SEQ ID NOs: 3569-3637.

The endonuclease may comprise an HNH domain having at least about 70% identity to any one of SEQ ID NOs: 5390-5460. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5390-5460. The endonuclease may comprise an HNH domain substantially identical to any one of SEQ ID NOs: 5390-5460. The endonuclease may comprise an HNH domain having at least about 70% identity to any one of SEQ ID NOs: 5390-5460. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5390-5460. The endonuclease may comprise an HNH domain substantially identical to any one of SEQ ID NOs: 5390-5460.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1756-1826. In some cases, the endonuclease may be substantially identical to any one of SEQ ID NOs: 1756-1826. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1756-1826. In some cases, the endonuclease may be substantially identical to any one of SEQ ID NOs: 1756-1826.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 1756-1826, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1756-1826. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5511. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5511. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5511. The tracrRNA may comprise SEQ ID NO: 5511.

In some cases, the at least one engineered synthetic guide ribonucleic acid (sgRNA) capable of forming a complex with the endonuclease may comprise a sequence having at least about 80% identity to SEQ ID NO: 5475. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5475. The sgRNA may comprise a sequence substantially identical to SEQ ID NO: 5475.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 3569-3637. The deoxyribonucleic acid (DNA) containing an open reading frame encoding said endonuclease may comprise a sequence substantially identical to SEQ ID NOs: 5587 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NOs: 5587. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

EXAMPLES

Example 1.—Metagenomic Analysis for New Proteins

Metagenomic samples were collected from sediment, soil and animal. Deoxyribonucleic acid (DNA) was extracted with a Zymobiomics DNA mini-prep kit and sequenced on an Illumina HiSeq® 2500. Samples were collected with consent of property owners. Additional raw sequence data from public sources included animal microbiomes, sediment, soil, hot springs, hydrothermal vents, marine, peat bogs, permafrost, and sewage sequences. Metagenomic sequence data was searched using Hidden Markov Models generated based on known Cas protein sequences including type II Cas effector proteins. Novel effector proteins identified by the search were aligned to known proteins to identify potential active sites. This metagenomic workflow resulted in delineation of the MG1, MG2, MG3, MG4, MG6, MG14, MG15, MG16, MG18, MG21, MG22, and MG23 families of class II, type II CRISPR endonucleases described herein.

Example 2A.—Discovery of an MG1 Family of CRISPR Systems

Analysis of the data from the metagenomic analysis of Example 1 revealed a new cluster of previously undescribed putative CRISPR systems initially comprising six members (MG1-1, MG1-2, MG1-3, MG1-4, MG1-5, and MG1-6 recorded as SEQ ID NOs: 5, 6, 1, 2, and 3 respectively). This family is characterized by an enzyme bearing HNH and RuvC domains. The RuvC domains of this family have a RuvC_III portion having low homology to previously described Cas9 family members. Although the initial family members have a maximum of 56.8% identity among them, all 6 enzymes exhibit a divergent RuvC_III portion of the RuvC domain and bear the common motif of RHHAL-DAMV (SEQ ID NO:5615), KHHALDAMC (SEQ ID NO:5616), or KHHALDAIC (SEQ ID NO:5617). These motifs are not found in other described Cas9-like enzymes. The corresponding protein and nucleic acid sequences for these new enzymes and their relevant subdomains are presented in the sequence listing. Putative tracrRNA sequences were identified based on their location relative to the other genes and are presented as SEQ ID NOs: 5476-5479. The enzyme systems appear to derive from the Phylum Verrucomicrobia, the Phylum Candidatus Peregrinibacteria, or the Phylum Candidatus Melainabacteria based on the sequences of 16S rRNAs from genome bins containing the CRISPR systems. The 16S rRNA sequences are presented as SEQ ID NOs: 5592-5596). A detailed domain-level alignment of the CRISPR system sequences together calling out the features described by Shmakov et al. (Mol Cell. 2015 Nov. 5; 60(3):385-97), which is entirely incorporated by reference) is depicted in FIGS. 9A, 9B, 9C, 9D, 9E, 9F, 9G, and 9H. A comparison of MG1-1, 1-2, and 1-3 versus additional proprietary protein datasets revealed additional protein sequences with similar architecture, presented as SEQ NOs: 7-319. These MG1 protein sequences led to the discovery of additional MG1 motifs as shown in SEQ ID NOs: 5618-5632.

Example 2B.—Discovery of an MG2 Family of CRISPR Systems

Figure 7:
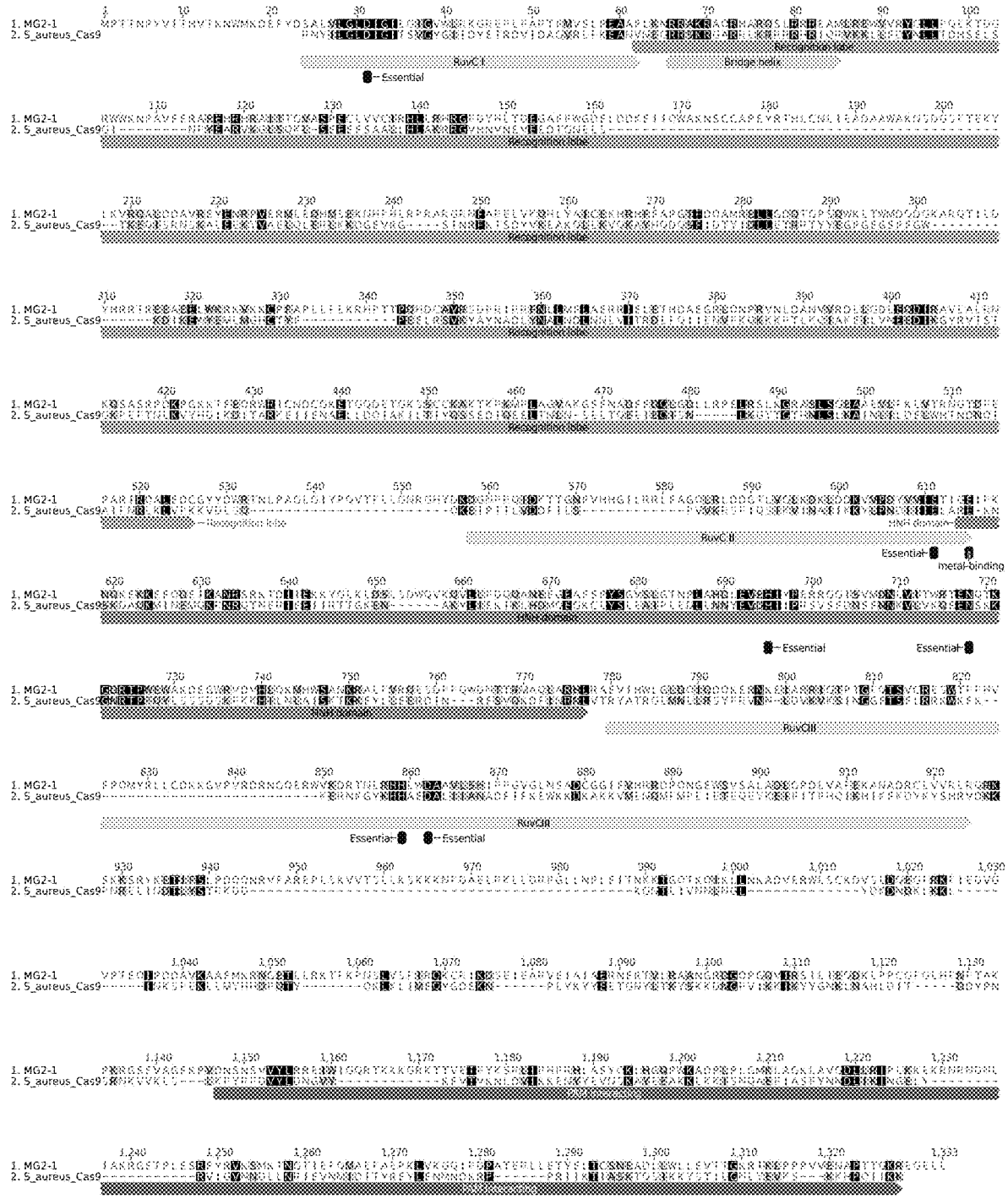
FIG. 7 depicts a structure-based alignment of an enzyme of the present disclosure (MG2-1) versus Cas9 from *Staphylococcus aureus* (SEQ ID NO:5613).
Figure 9A:
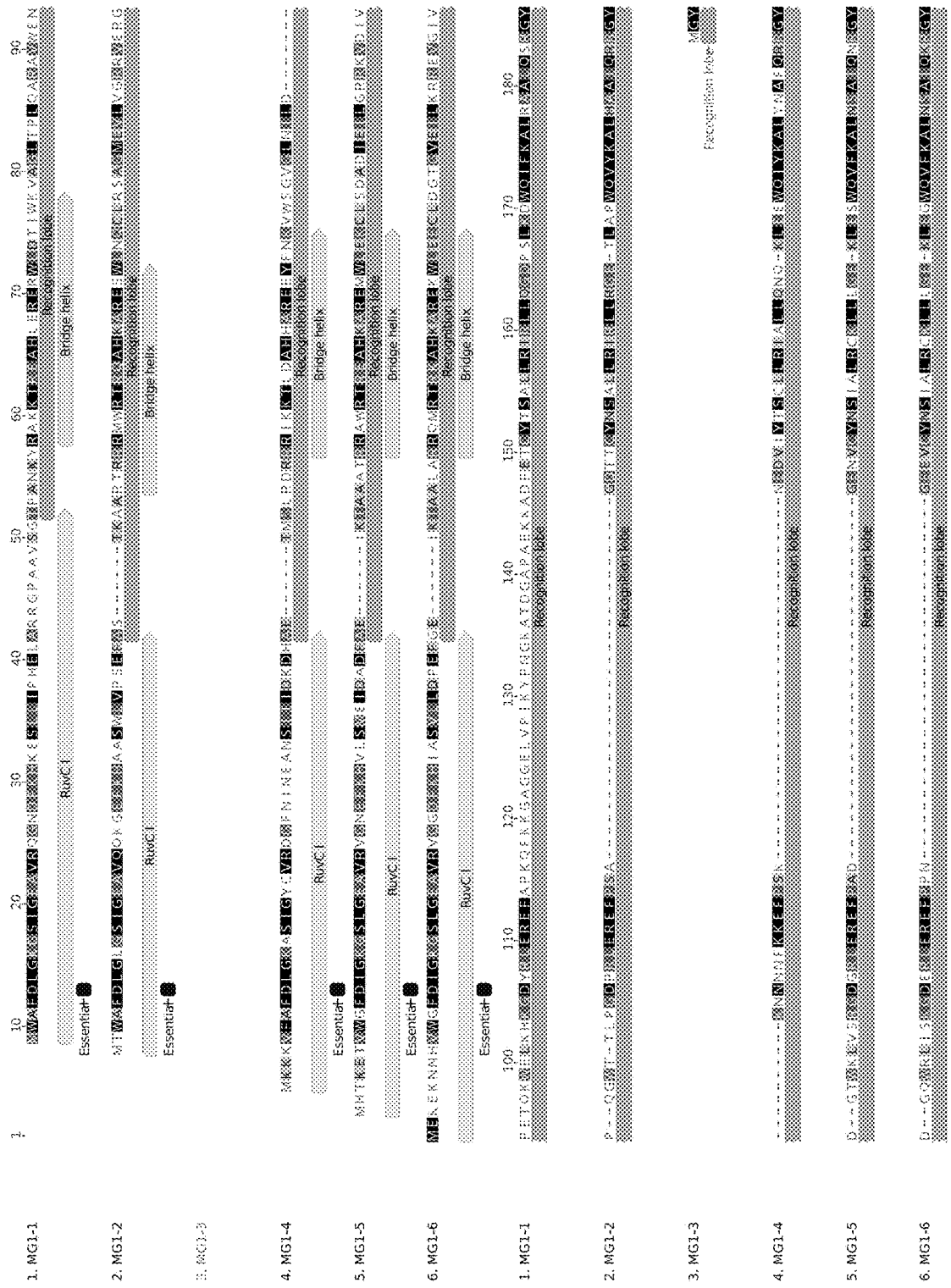
FIGS. 9A, 9B, 9C, 9D, 9E, 9F, 9G, and 9H depicts a structure-based alignment of MG1 family enzymes MG1-1 through MG1-6 (SEQ ID NOs: 5, 6, 9, 1, 2, and 3).
Figure 9B:
Figure 9C:
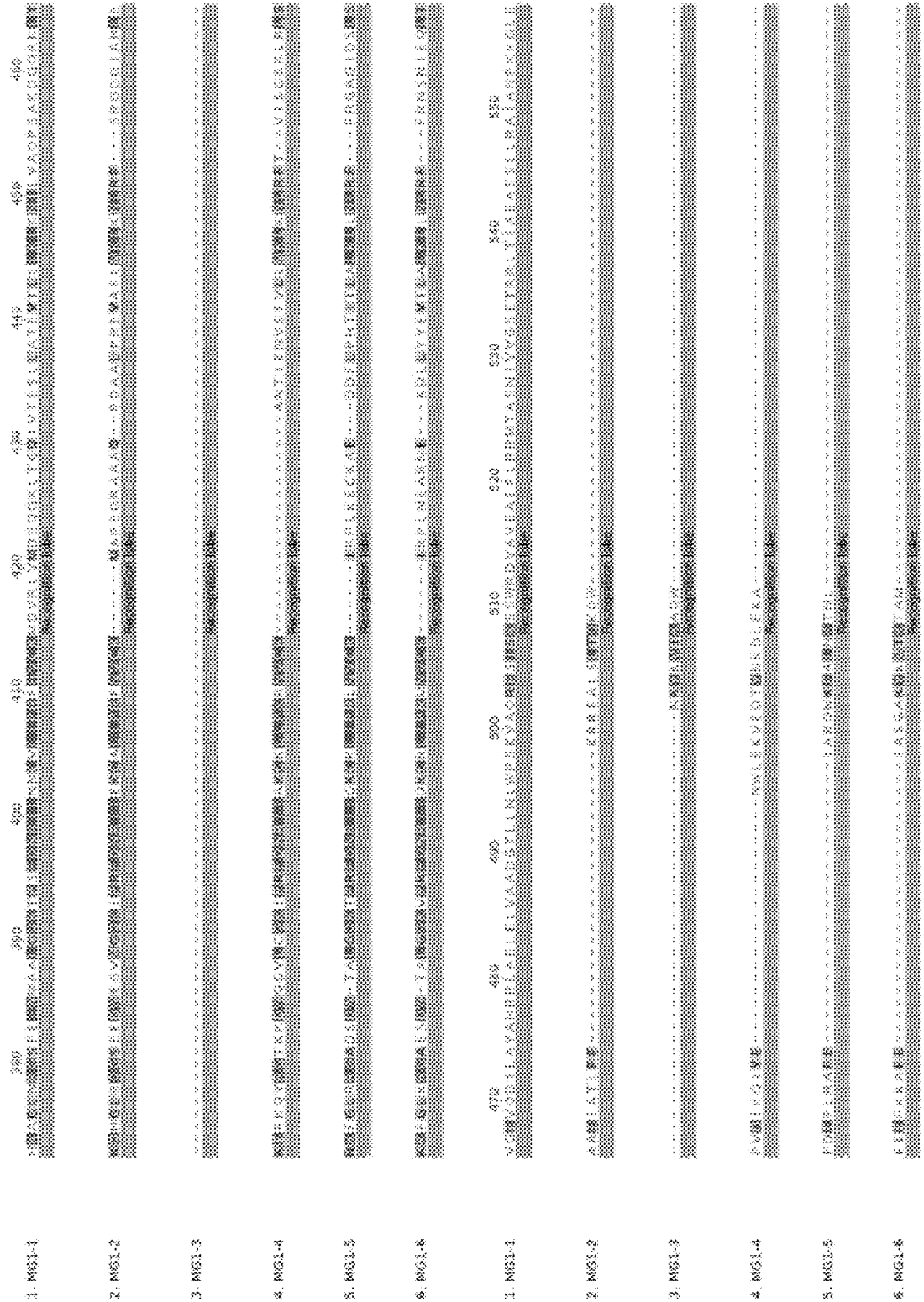
Figure 9D:
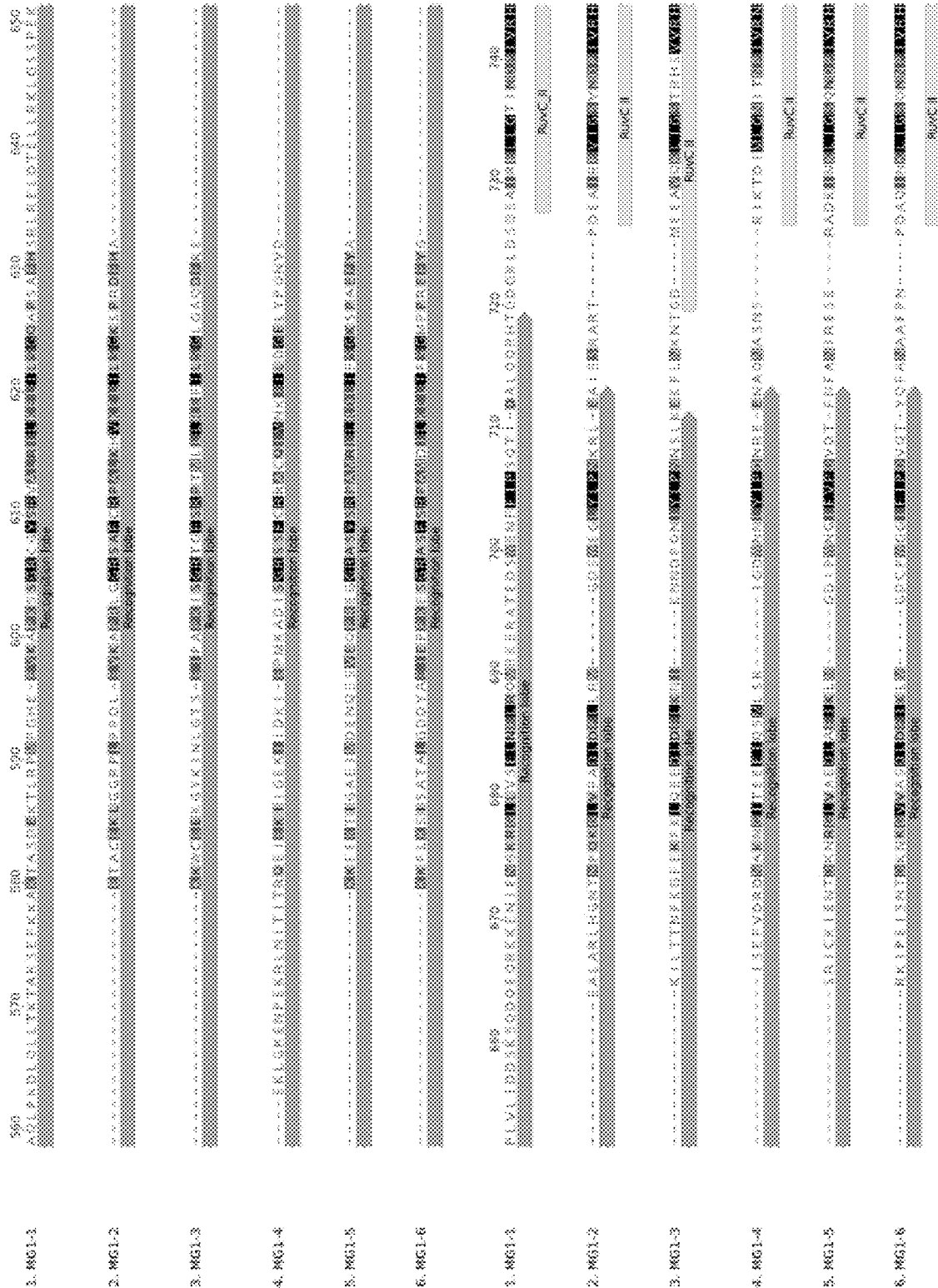
Figure 9E:
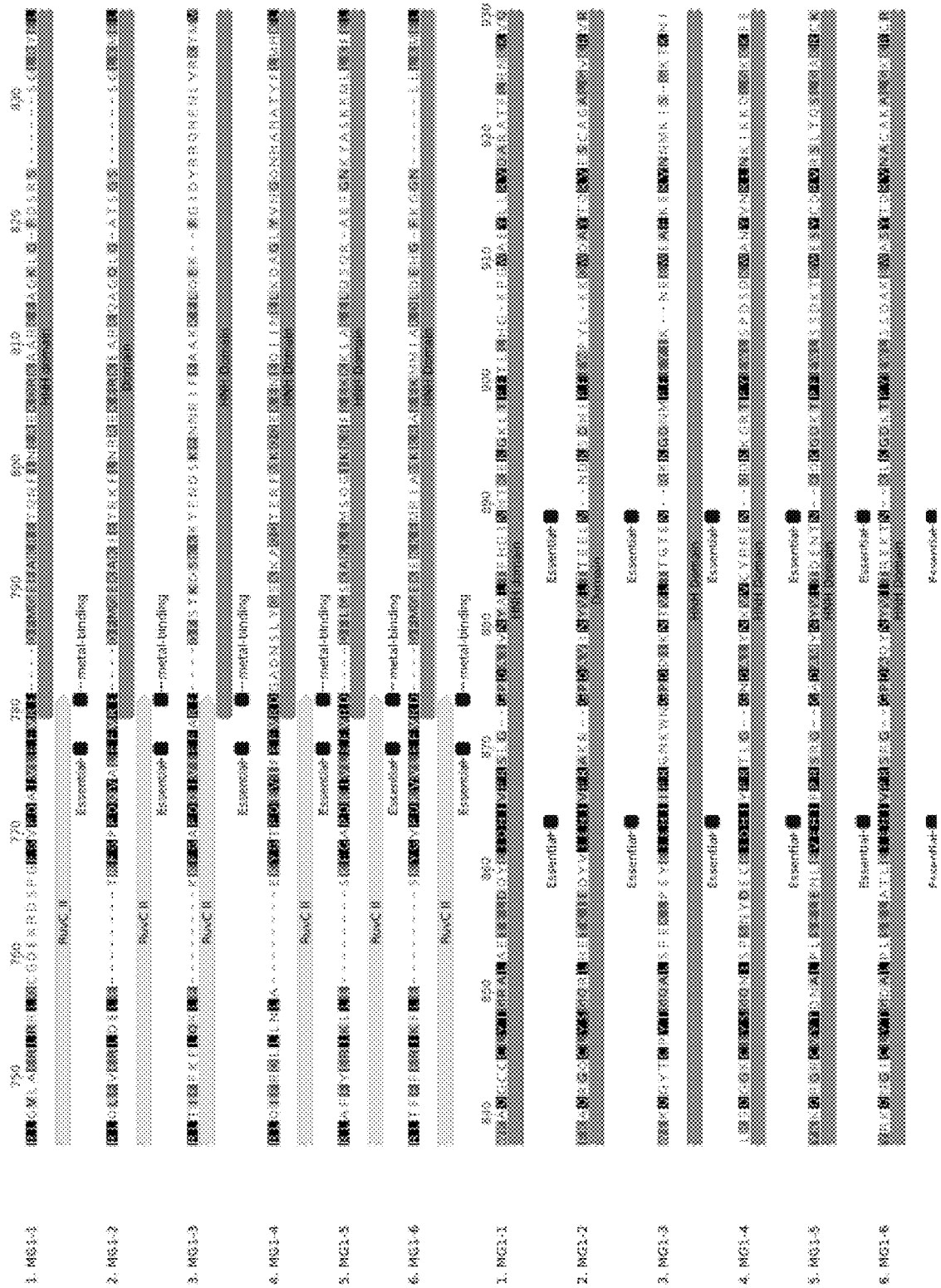
Figure 9F:
Figure 9G:
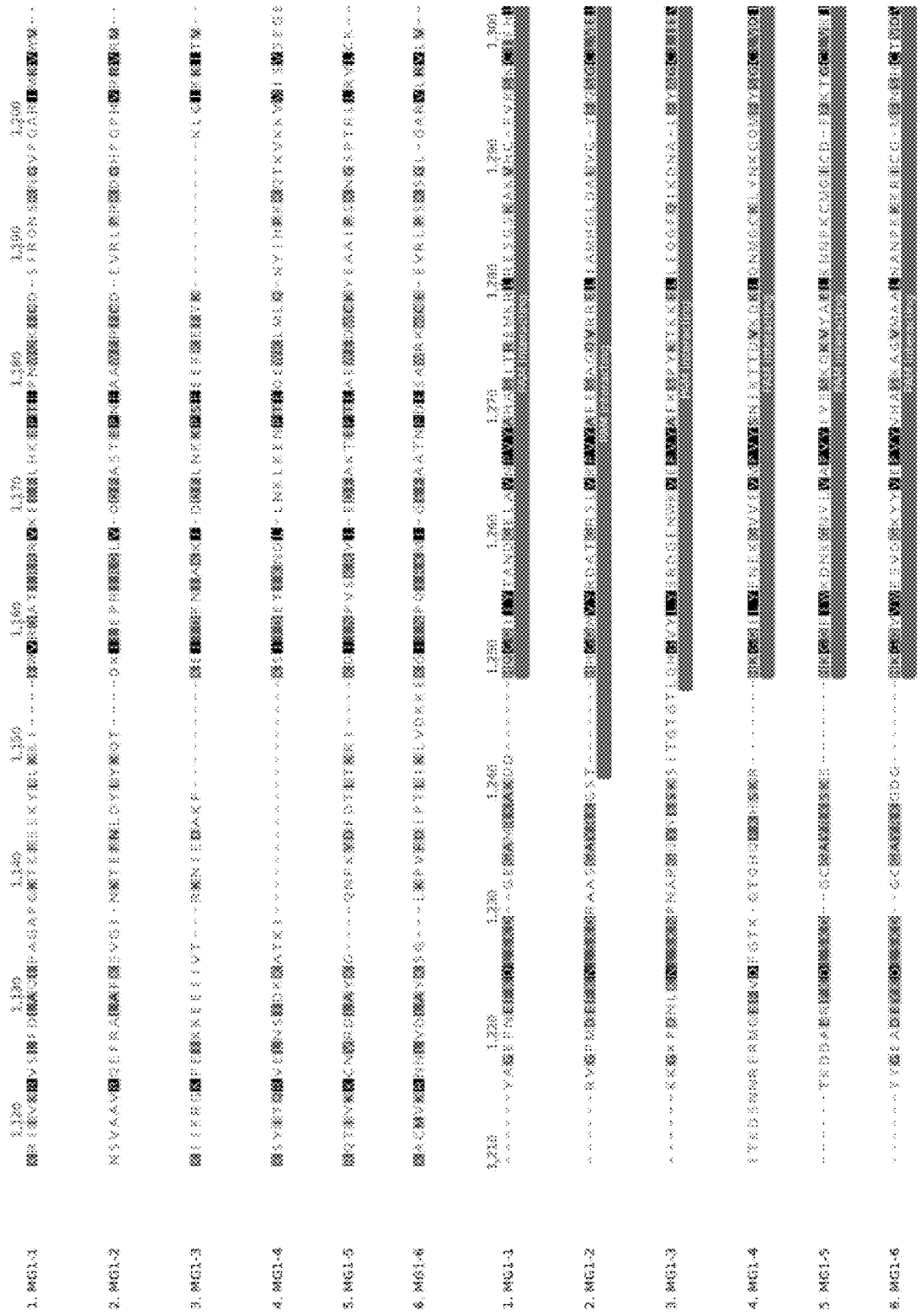
Figure 9H:
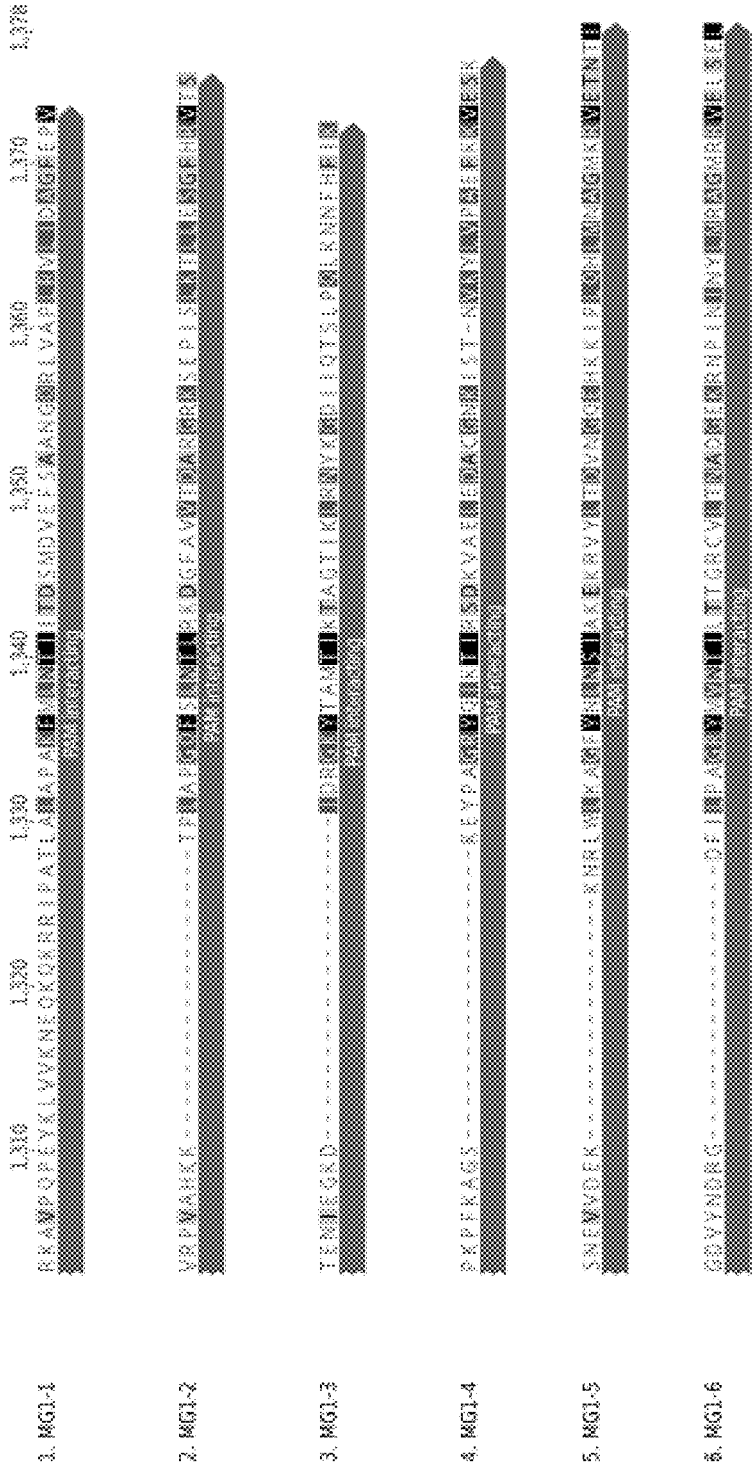

Analysis of data from the metagenomic analysis of Example 1 revealed a new cluster of previously undescribed putative CRISPR systems comprising six members (MG2-1, MG2-2, MG2-3, MG2-5, and MG2-6). The corresponding protein and nucleic acid sequences for these new enzymes and exemplary subdomains are presented as SEQ ID NOs: 320, 322-325. Based on their location relative to the other genes, putative tracrRNA sequences were identified in the operon and are presented as SEQ ID NOs: 5490, 5492-5494, and 5538. A detailed domain-level alignment of these sequences versus Cas9 as outlined in Shmakov et al. (Mol Cell. 2015 Nov. 5; 60(3):385-97.), is depicted in FIG. 7.

A comparison of MG2-1, MG2-2, MG2-3, MG2-5, and MG2-6 versus additional proprietary protein datasets revealed additional protein sequences with similar architecture, presented as SEQ NOs: 321 and 326-420. Motifs commonly found in MG2 family members are presented as SEQ ID NOs: 5631-5638.

Example 2C.—Discovery of an MG3 Family of CRISPR Systems

Figure 8:
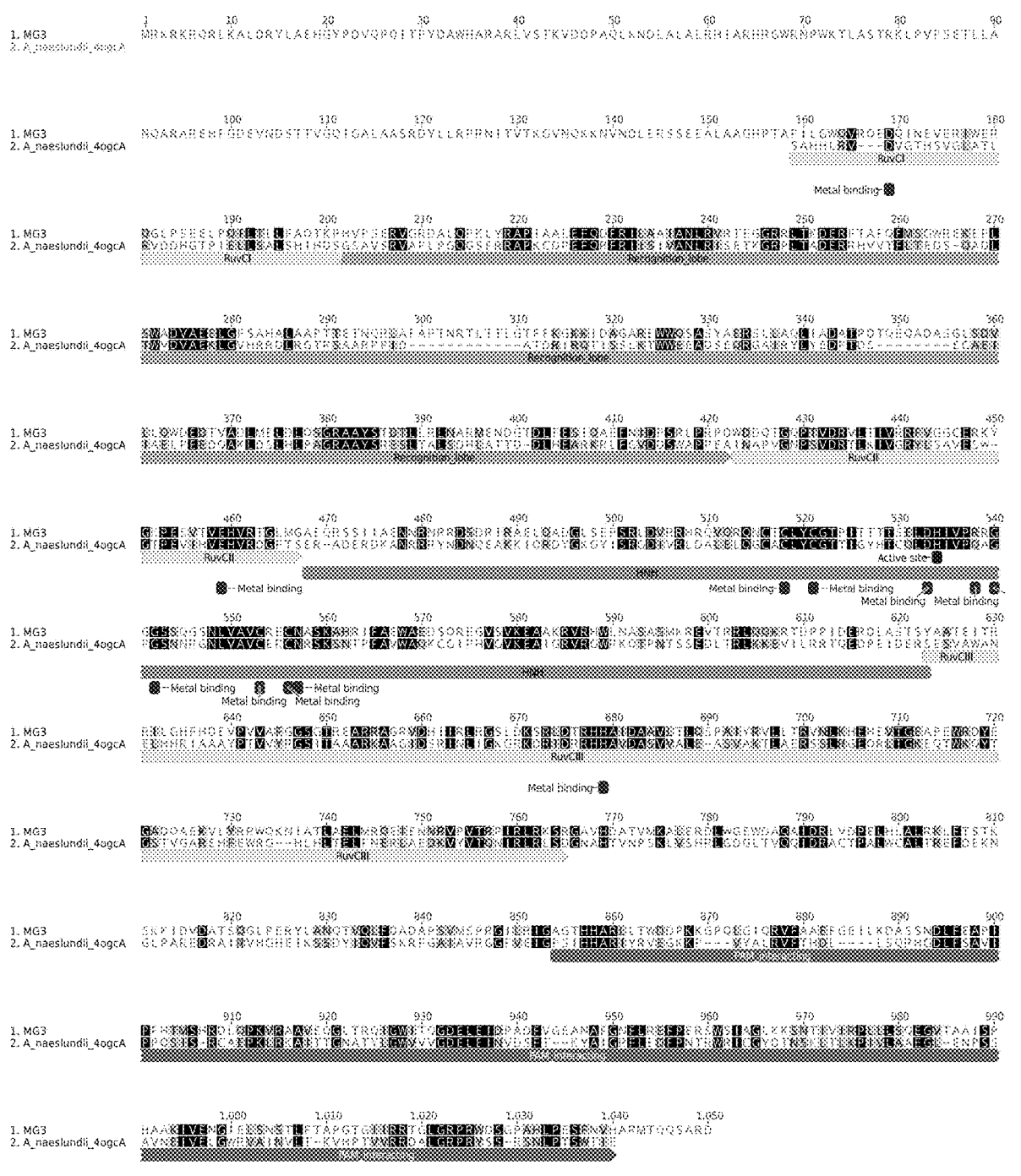

Analysis of the data from the metagenomic analysis of Example 1 revealed a new previously undescribed putative CRISPR system: MG3-1. The corresponding amino acid sequences for this new enzyme and its exemplary subdomains are presented as SEQ ID NOs: 424, 2245, and 4059. Based on proximity to the other elements in the operon, a putative tracrRNA containing sequence was identified and is included as SEQ ID NO: 5498. A detailed domain-level alignment of the sequence versus Cas9 from *Actinomyces naeslundii* is depicted in FIG. 8.

A comparison of MG3-1 versus additional proprietary protein datasets revealed additional protein sequences with similar architecture, presented as SEQ NOs: 421-423, 425-431.

Example 2D.—Discovery of MG4, 7, 14, 15, 16, 18, 21, 22, 23 Families of CRISPR Systems Analysis of the data from the metagenomic analysis of Example 1 revealed new clusters of previously undescribed putative CRISPR systems comprising 9 families of one member each (MG 4-5, MG7-2, MG14-1, MG15-1, MG16-2, MG18-1, MG21-1, MG22-1, MG23-1). The corresponding protein and nucleic acid sequences for these new enzymes and their exemplary subdomains are presented as SEQ ID NOs: 432, 669, 678, 930, 1093, 1354, 1512, 1656, 1756. Based on proximity to the other elements in the operon, a putative tracr containing sequence was identified for each family. These sequences are presented in the sequence listing as SEQ ID NOs: 5503-5511, respectively.

A comparison of MG 4-5, MG7-2, MG14-1, MG15-1, MG16-2, MG18-1, MG21-1, MG22-1, MG23-1 versus additional proprietary protein datasets revealed additional protein sequences with similar architecture, presented as SEQ NOs: 433-660, 670-677, 679-929, 931-1092, 1094-1353, 1355-1511, 1513-1655, 1657-1755, and 1757-1826. Motifs common to the nucleases of these sets of CRISPR systems are presented as SEQ ID NO: 5649 for MG4; SEQ ID NOs: 5650-5667 for MG14; 5668-5675 for MG15; SEQ ID NOs: 5676-5678 for MG16; SEQ ID NOs: 5679-5686 for MG18; SEQ ID NOs: 5687-5693 and SEQ ID NOs: 5674-5675 for MG21; SEQ ID NOs: 5694-5699 for MG22; and SEQ ID NOs: 5700-5717 for MG23.

Example 3.—Prophetic—Determination of Protospacer-Adjacent Motif

Experiments are performed as in any of the examples in Karvelis et al. Methods. 2017 May 15; 121-122:3-8, which is entirely incorporated by reference herein, to identify the protospacer adjacent motif (PAM) sequence specificity for the novel enzymes described herein to allow for optimal synthetic sequence targeting.

In one example (in-vivo screen), cells bearing plasmids encoding any of the enzymes described herein and protospacer-targeting guide RNA are co-transformed with a plasmid library containing an antibiotic resistance gene, and a protospacer sequence flanked by a randomized PAM sequence. Plasmids containing functional PAMs are cleaved by the enzyme, leading to cell death. Deep-sequencing of the enzyme cleavage-resistant plasmid pool isolated from the surviving cells displays a set of depleted plasmids that contain functional cleavage-permitting PAMs.

In another example (in vitro screen), PAM library in the form of DNA plasmid or concatemeric repeats is subjected to cleavage by the RNP complex (e.g., including the enzyme, tracrRNA and crRNA or the enzyme and hybrid sgRNA) assembled in vitro or in cell lysates. Resulting free DNA ends from successful cleavage events are captured by adapter ligation, followed by the PCR amplification of the PAM-sided products. Amplified library of functional PAMs is subjected to deep sequencing and PAMs licensing DNA cleavage are identified.

Example 4.—Prophetic—Use of Synthetic CRISPR System as Described Herein in a Mammalian Cell for Genome Editing DNA/RNA sequences encoding (i) an ORF encoding codon-optimized enzyme under a cell-compatible promoter with a cell-compatible C-terminal nuclear localization sequence (e.g., SV40 NLS in the case of human cells) and a suitable polyadenylation signal (e.g., TK pA signal in the case of human cells); and (ii) an ORF encoding an sgRNA (having a 5' sequence beginning with G followed by 20 nt of a complementary targeting nucleic acid sequence targeting genomic DNA followed by a corresponding compatible PAM identified via Example 3 and a 3' tracr-binding sequence, a linker, and the tracrRNA sequence) under a suitable Polymerase III promoter (e.g., the U6 promoter in mammalian cells) are prepared. In some embodiments, these sequences are prepared on the same or separate plasmid vectors, which are transfected via a suitable technique into eukaryotic cells. In some embodiments, these sequences are prepared as separate DNA sequences, which are transfected or microinjected into cells. In some embodiments, these sequences are prepared as synthesized RNAs or in-vitro transcribed RNAs which are transfected or microinjected into cells. In some embodiments, these sequences are translated into proteins and transfected or microinjected into cells.

Whichever transfection method is selected, (i) and (ii) are introduced into cells. A period of incubation is allowed to pass so that the enzyme and/or sgRNA can be transcribed and/or translated into active form. After the incubation period, genomic DNA in the vicinity of the targeting sequence is analyzed (e.g., by sequencing). An indel is introduced into the genomic DNA in the vicinity of the targeting sequence as a result of enzyme-mediated cleavage and non-homologous end joining.

In some embodiments, (i) and (ii) are introduced into cells with a third repair nucleotide that encodes regions of the genome flanking the cleavage site of sizes 25 bp or larger, which will facilitate homology directed repair. Containing within these flanking sequences may be a single base pair mutation, a functional gene fragment, a foreign or native gene for expression, or several genes composing a biochemical pathway.

Example 5.—Prophetic—Use of Synthetic CRISPR System as Described Herein In Vitro Any of the enzymes described herein are cloned into a suitable E. coli expression plasmid containing a purification tag and are recombinantly expressed in E. coli and purified using the recombinant tag. RNAs comprising a 5' G followed by a 20 nt targeting sequence and PAM sequence, a tracrRNA binding region of a compatible crRNA, a GAAA linker, and a compatible tracrRNA are synthesized by suitable solid-phase RNA synthesis methods. Recombinant enzymes and sgRNA are combined in a suitable cleavage buffer containing Mg2+(e.g., 20 mM HEPES pH 7.5, 100 mM KCl, 5 mM $MgCl_2$, 1 mM DTT, 5% glycerol) and the reaction is initiated by introducing a target DNA including a sequence complementary to the targeting sequence and PAM sequence. Cleavage of the DNA is monitored by a suitable assay (e.g., agarose gel electrophoresis followed by ethidium bromide staining (or similarly acting DNA-intercalating agent) and UV visualization).

Example 6.—(General Protocol) PAM Sequence Identification/Confirmation for the Endonucleases Described Herein PAM sequences were determined by sequencing plasmids containing randomly-generated PAM sequences that could be cleaved by putative endonucleases expressed in an E. coli lysate-based expression system (myTXTL, Arbor Biosciences). In this system, an E. coli codon optimized nucleotide sequence was transcribed and translated from a PCR fragment under control of a T7 promoter. A second PCR fragment with a tracr sequence under a T7 promoter and a minimal CRISPR array composed of a T7 promoter followed by a repeat-spacer-repeat sequence was transcribed in the same reaction. Successful expression of the endonuclease and tracr sequence in the TXTL system followed by CRISPR array processing provided active in vitro CRISPR nuclease complexes.

A library of target plasmids containing a spacer sequence matching that in the minimal array followed by 8N mixed bases (putative PAM sequences) was incubated with the output of the TXTL reaction. After 1-3 hr, the reaction was stopped and the DNA was recovered via a DNA clean-up kit, e.g., Zymo DCC, AMPure XP beads, QiaQuick etc. Adapter sequences were blunt-end ligated to DNA with active PAM sequences that had been cleaved by the endonuclease, whereas DNA that had not been cleaved was inaccessible for ligation. DNA segments comprising active PAM sequences were then amplified by PCR with primers specific to the library and the adapter sequence. The PCR amplification products were resolved on a gel to identify amplicons that corresponded to cleavage events. The amplified segments of the cleavage reaction were also used as template for preparation of an NGS library. Sequencing this resulting library, which was a subset of the starting 8N library, revealed the sequences which contain the correct PAM for the active CRISPR complex. For PAM testing with a single RNA construct, the same procedure was repeated except that an in vitro transcribed RNA was added along with the plasmid library and the tracr/minimal CRISPR array template was omitted. For endonucleases where NGS libraries were prepared, seqLogo (see e.g., Huber et al. Nat Methods. 2015 February; 12(2):115-21) representations were constructed and are presented in FIGS. 27, 38, 29, 30, 31, 32, 33, 34, and 35. The seqLogo module used to construct these representations takes the position weight matrix of a DNA sequence motif (e.g. a PAM sequence) and plots the corresponding sequence logo as introduced by Schneider and Stephens (see e.g. Schneider et al. Nucleic Acids Res. 1990 Oct. 25; 18(20):6097-100. The characters representing the sequence in the seqLogo representations have been stacked on top of each other for each position in the aligned sequences (e.g. PAM sequences). The height of each letter is proportional to its frequency, and the letters have been sorted so the most common one is on top.

Example 7.—(General Protocol) RNA Folding of tracrRNA and sgRNA Structures

Folded structures of guide RNA sequences at 37° C. were computed using the method of Andronescu et al. Bioinformatics. 2007 Jul. 1; 23(13):i19-28, which is incorporated by reference herein in its entirety. Predicted structures of exemplary sgRNAs described herein are presented in FIGS. 21, 22, 23, 24, 25, and 26.

Example 8.—(General Protocol) In Vitro Cleavage Efficiency of MG CRISPR Complexes Endonucleases were expressed as His-tagged fusion proteins from an inducible T7 promoter in a protease deficient E. coli B strain. Cells expressing the His-tagged proteins were lysed by sonication and the His-tagged proteins were purified by Ni-NTA affinity chromatography on a HisTrap FF column (GE Lifescience) on an AKTA Avant FPLC (GE Lifescience). The eluate was resolved by SDS-PAGE on acrylamide gels (Bio-Rad) and stained with InstantBlue Ultrafast coomassie (Sigma-Aldrich). Purity was determined using densitometry of the protein band with Image-Lab software (Bio-Rad). Purified endonucleases were dialyzed into a storage buffer composed of 50 mM Tris-HCl, 300 mM NaCl, 1 mM TCEP, 5% glycerol; pH 7.5 and stored at −80° C.

Target DNAs containing spacer sequences and PAM sequences (determined e.g., as in Example 6) were constructed by DNA synthesis. A single representative PAM was chosen for testing when the PAM had degenerate bases. The target DNAs comprised 2200 bp of linear DNA derived from a plasmid via PCR amplification with a PAM and spacer located 700 bp from one end. Successful cleavage resulted in fragments of 700 and 1500 bp. The target DNA, in vitro transcribed single RNA, and purified recombinant protein were combined in cleavage buffer (10 mM Tris, 100 mM NaCl, 10 mM $MgCl_2$) with an excess of protein and RNA and incubated for 5 minutes to 3 hours, usually 1 hr. The reaction was stopped via addition of RNAse A and incubation at 60 minutes. The reaction was then resolved on a 1.2% TAE agarose gel and the fraction of cleaved target DNA is quantified in ImageLab software.

Example 9.—(General Protocol) Testing of Genome Cleavage Activity of MG CRISPR Complexes in E. coli E. coli lacks the capacity to efficiently repair double-stranded DNA breaks. Thus, cleavage of genomic DNA can be a lethal event. Exploiting this phenomenon, endonuclease activity was tested in E. coli by recombinantly expressing an endonuclease and a tracrRNA in a target strain with spacer/target and PAM sequences integrated into its genomic DNA.

In this assay, the PAM sequence is specific for the endonuclease being tested as determined by the methods described in Example 6. sgRNA sequences were determined based upon the sequence and predicted structure of the tracrRNA. Repeat-anti-repeat pairings of 8-12 bp (generally 10 bp) were chosen, starting from the 5' end of the repeat. The remaining 3' end of the repeat and 5' end of the tracrRNA were replaced with a tetraloop. Generally, the tetraloop was GAAA, but other tetraloops can be used, particularly if the GAAA sequence is predicted to interfere with folding. In these cases, a TTCG tetraloop was used.

Engineered strains with PAM sequences integrated into their genomic DNA were transformed with DNA encoding the endonuclease. Transformants were then made chemocompetent and transformed with 50 ng of single guide RNAs either specific to the target sequence ("on target"), or non-specific to the target ("non target"). After heat shock, transformations were recovered in SOC for 2 hrs at 37° C. Nuclease efficiency was then determined by a 5-fold dilution series grown on induction media. Colonies were quantified from the dilution series in triplicate.

Example 10a.—(General Protocol) Testing of Genome Cleavage Activity of MG CRISPR Complexes in Mammalian Cells To show targeting and cleavage activity in mammalian cells, the MG Cas effector protein sequences were tested in two mammalian expression vectors: (a) one with a C-terminal SV40 NLS and a 2A-GFP tag, and (b) one with no GFP tag and two SV40 NLS sequences, one on the N-terminus and one on the C-terminus. In some instances, nucleotide sequences encoding the endonucleases were codon-optimized for expression in mammalian cells.

The corresponding single guide RNA sequence (sgRNA) with targeting sequence attached is cloned into a second mammalian expression vector. The two plasmids are cotransfected into HEK293T cells. 72 hr after co-transfection of the expression plasmid and a sgRNA targeting plasmid into HEK293T cells, the DNA is extracted and used for the preparation of an NGS-library. Percent NHEJ is measured via indels in the sequencing of the target site to demonstrate the targeting efficiency of the enzyme in mammalian cells. At least 10 different target sites were chosen to test each protein's activity.

Example 10b. (General Protocol) Testing of Genome Cleavage Activity of MG CRISPR Complexes in Mammalian Cells To show targeting and cleavage activity in mammalian cells, the MG Cas effector protein sequences were cloned into two mammalian expression vector: (a) one with flanking N and C-terminal SV40 NLS sequences, a C-terminal His tag, and a 2A-GFP tag at the C terminus after the His tag (Backbone 1), and (b) one with flanking NLS sequences and C-terminal His tag but no T2A GFP tag (Backbone 2). In some instances, nucleotide sequences encoding the endonucleases were the native sequence, codon-optimized for expression in E. coli, or codon-optimized for expression in mammalian cells.

The corresponding single guide RNA sequence (sgRNA) with targeting sequence attached was cloned into a second mammalian expression vector. The two plasmids were cotransfected into HEK293T cells. 72 hr after co-transfection of the expression plasmid and a sgRNA targeting plasmid into HEK293T cells, the DNA was extracted and used for the preparation of an NGS-library. Percent NHEJ was measured via indels in the sequencing of the target site to demonstrate the targeting efficiency of the enzyme in mammalian cells. About 7-12 different target sites were chosen for testing each protein's activity. An arbitrary threshold of 5% indels was used to identify active candidates.

Example 11.—Characterization of MG1 Family Members

PAM Specificity, tracrRNA/sgRNA Validation

The targeted endonuclease activity of MG1 family endonuclease systems was confirmed using the myTXTL system described in Example 6. In this assay, PCR amplification of cleaved target plasmids yields a product that migrates at approximately 170 bp in the gel, as shown in FIGS. 17-20. Amplification products were observed for MG1-4 (dual guide: see gel 1, lane 3, single guide: see gel 6 lane 2), MG1-5 (gel 2 lane 10), MG1-6 (dual guide: see gel 5 lane 6, single guide see: gel 6 lane 5), and MG1-7 (dual guide: see gel 3 lane 13, single guide: see gel 3 lane 2) (protein SEQ ID NOs: 1-4, respectively). Sequencing the PCR products revealed active PAM sequences for these enzymes as shown in Table 2.

TABLE 2

| | PAM sequence specificities and related data for MG1 enzymes | | | | | | |
|---|---|---|---|---|---|---|---|
| Enzyme | Enzyme protein SEQ ID NO | Native (dual guide) PAM | PAM SEQ ID NO: | tracrRNA SEQ ID NO: | sgRNA SEQ ID NO: | Synthetic (single guide) PAM | Synthetic (single guide) PAM SEQ ID NO: |
| MG1-4 | 1 | nRRRAA | 5527 | 5476 | 5461 | nRRR | 5512 |
| MG1-5 | 2 | nnnnCC | 5528 | 5477 | 5462 | nnnnYY | 5513 |
| MG1-6 | 3 | nnRRAC | 5529 | 5478 | 5463 | nnRRAY | 5514 |
| MG1-7 | 4 | nRRRAA | 5530 | 5479 | 5464 | nRRRAAG | 5515 |

Synthetic single guide RNAs (sgRNAs) were designed based on the sequences and predicted structures of the tracrRNAs and are presented as SEQ ID NOs: 5461-5464. The PAM sequence screen of Example 6 was repeated with the sgRNAs. The results of this experiment are also presented in Table 2, which reveals that PAM specificity changed slightly when using sgRNAs.

Targeted Endonuclease Activity In Vitro

Figure 10:
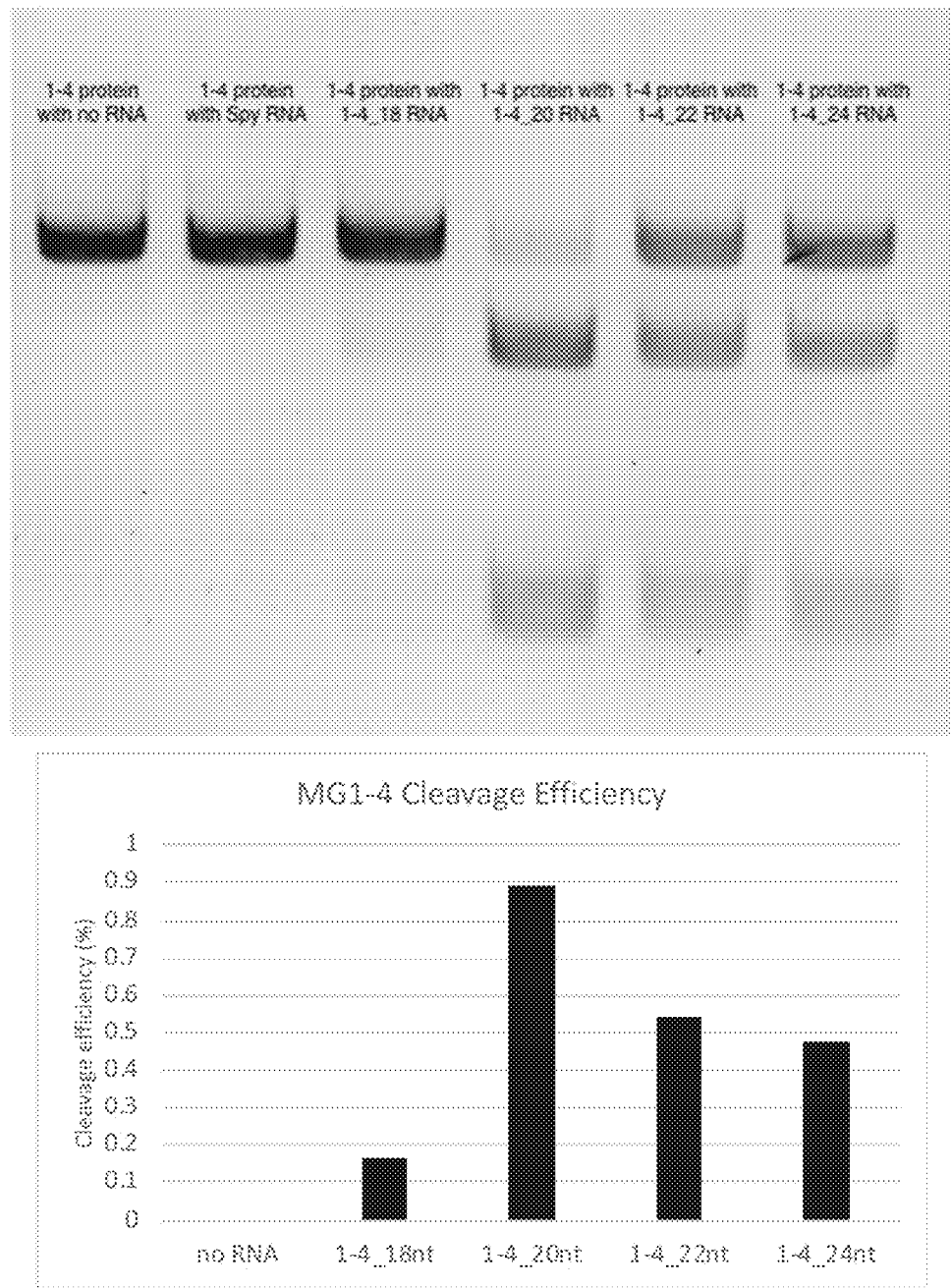
FIG. 10 depicts in vitro cleavage of DNA by MG1-4 in complex with its corresponding sgRNA containing targeting sequences of varying lengths.

In vitro activity of the MG1-4 endonuclease system (protein SEQ ID NO: 1 with sgRNA SEQ ID NO: 5461) on a target DNA with a PAM sequence CAGGAAGG was verified using the method of Example 8. The single guide sequence reported above (SEQ ID NO: 5461) was used, with varying spacer/targeting sequence lengths from 18-24 nt replacing the Ns of the sequence. The results are shown in FIG. 10, wherein the left panel shows a gel demonstrating DNA cleavage by MG1-4 in combination with corresponding single guide sgRNAs having different targeting sequence lengths (18-24nt), and the right panel shows the same data quantified as a bar graph. The data demonstrated that targeting sequences from 18-24 nucleotides were functional with the MG1-4/sgRNA system.

Targeted Endonuclease Activity in Bacterial Cells

Figure 11:
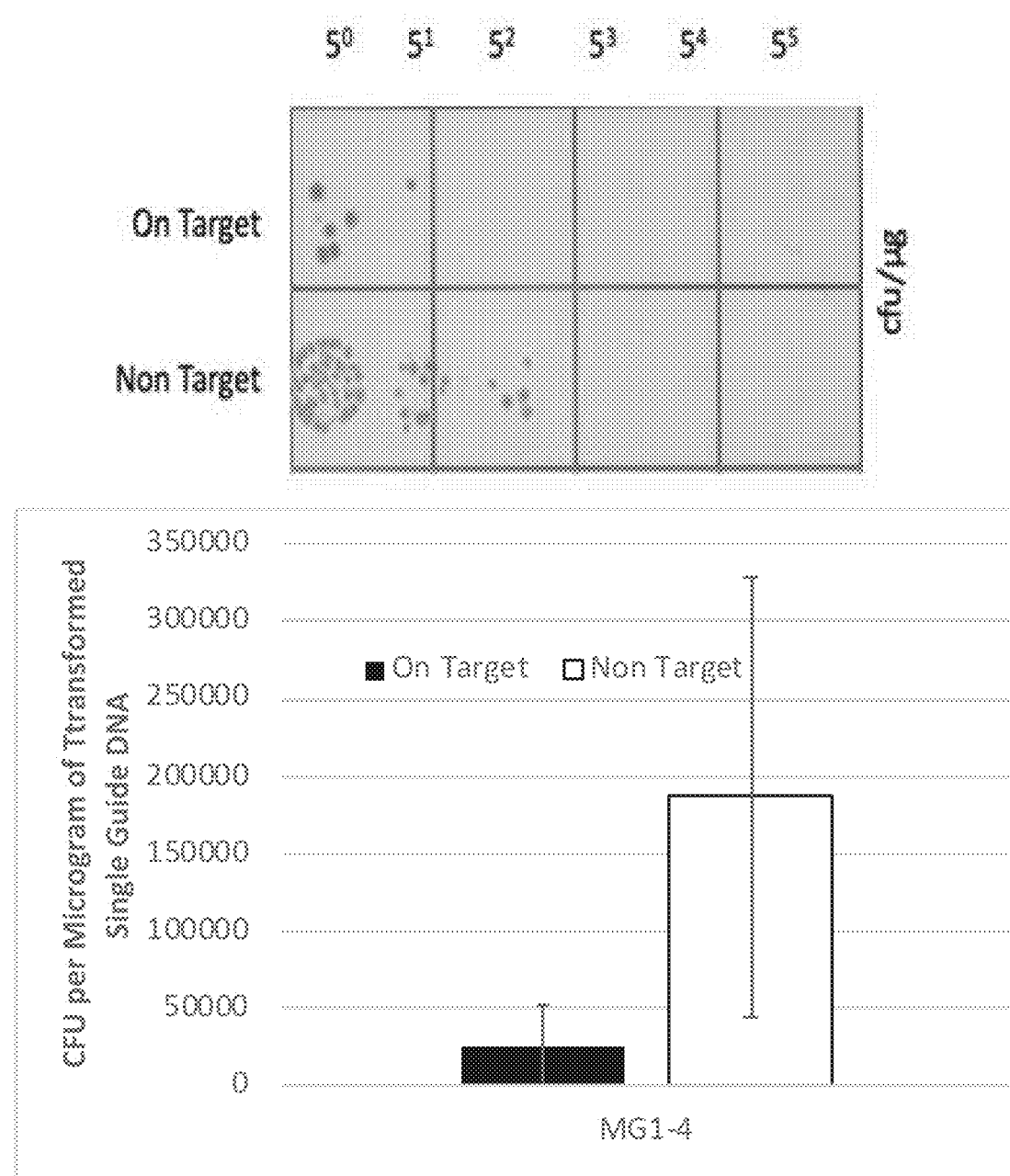
FIG. 11 depicts in cell cleavage of *E. coli* genomic DNA using MG1-4 along with its corresponding sgRNA. Shown are dilution series of cells transformed with MG1-4 along with target or non-target spacer (top); bottom panel shows the data quantitated, where the left bar represents non-target sgRNA and the right bar represents target sgRNA.

In vivo activity of the MG1-4 endonuclease system (protein SEQ ID NO: 1, sgRNA SEQ ID NO: 5461) was tested with the PAM sequence CAGGAAGG as in Example 9. Transformed *E. coli* were plated in serial dilution, and the results (showing *E. coli* serial dilutions in the left panel and quantitated growth in the right panel) are presented in FIG. 11. A substantial reduction in the growth of *E. coli* expressing on target sgRNA compared to *E. coli* expressing non-target sgRNA indicates that genomic DNA was specifically cleaved by the endonuclease in *E. coli* cells.

Targeted Endonuclease Activity in Mammalian Cells (a)

Figure 12:
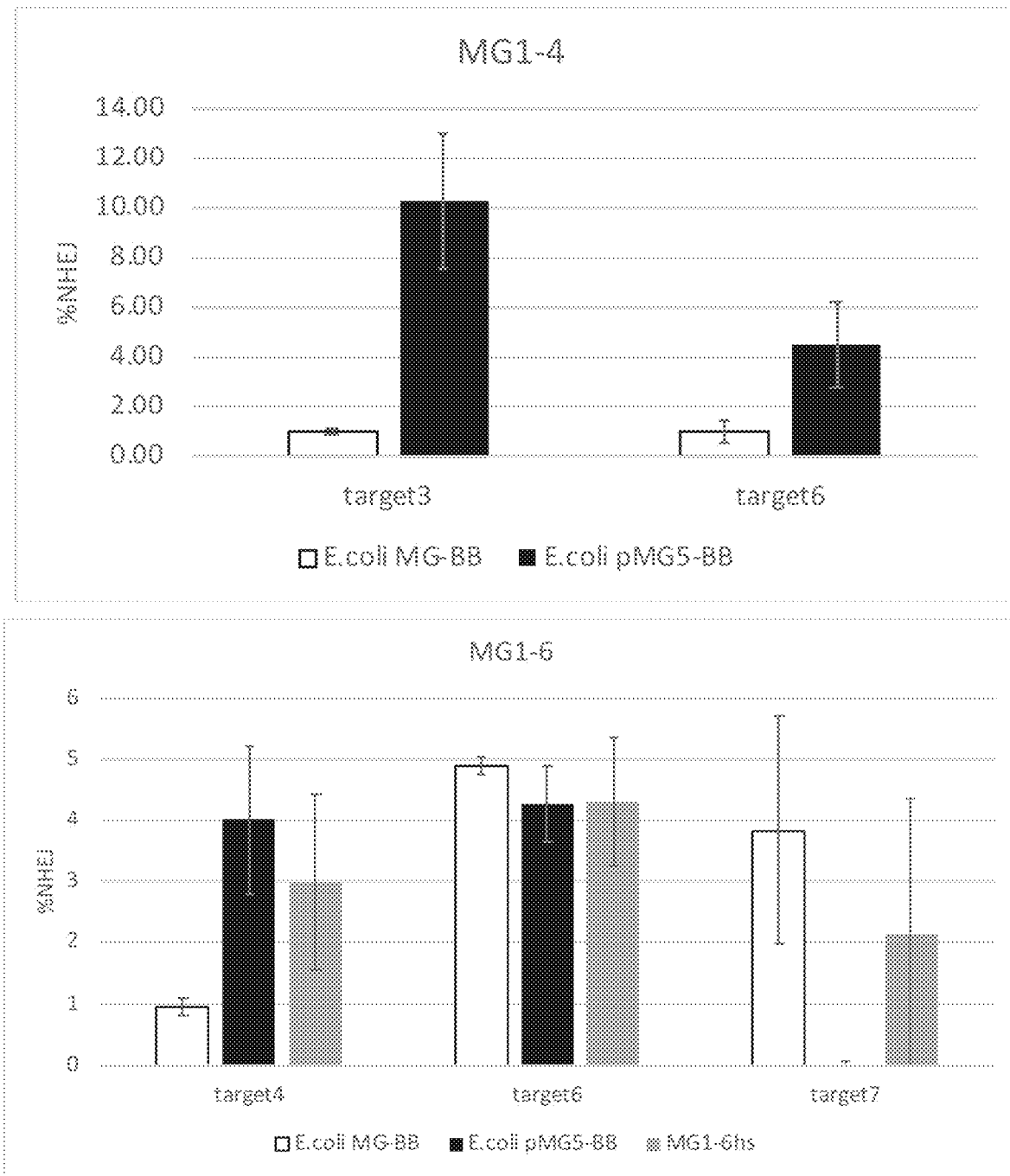
FIG. 12 depicts in cell indel formation generated by transfection of HEK cells with MG1-4 or MG1-6 constructs described in Example 11 alongside their corresponding sgRNAs containing various different targeting sequences targeting various locations in the human genome.

The method of Example 10 was used to demonstrate targeting and cleavage activity in mammalian cells. Open reading frames encoding the MG1-4 (protein SEQ ID NO: 5527) and MG1-6 (protein SEQ ID NO: 5529) sequences were cloned into 2 mammalian expression vectors, one with a C-terminal SV40 NLS and a 2A-GFP tag (*E. coli* MG-BB) and one with no GFP tag and 2 NLS sequences, one on the N-terminus and one on the C-terminus (*E. coli* pMG5-BB). For MG1-6, the open reading frame was additionally codon-optimized for mammalian expression (SEQ ID NO: 5589) and cloned into the 2-NLS plasmid backbone (MG-16hs). The results of this experiment are shown in FIG. 12. The endonuclease expression vectors were cotransfected into HEK293T cells with a second vector for expressing a sgRNA (e.g., SEQ ID NOs: 5512 or 5515) with a tracr sequence specific for the endonuclease and a guide sequence selected from Tables 3-4. 72 hr after co-transfection the DNA was extracted and used for the preparation of an NGS-library. Cleavage activity was detected by the appearance of internal deletions (NHEJ remnants) proximal to the sequence of the target site. Percent NHEJ was measured via indels in the sequencing of the target site to demonstrate the targeting efficiency of the enzyme in mammalian cells and is presented in FIG. 12.

TABLE 3

MG1-4 mammalian targeting sequences

| MG1-4 Target ID | MG1-4 Targeting Sequence | Targeting sequence SEQ ID NO: | Targeted Gene |
|---|---|---|---|
| 1 | aatatgtagctgtttgggaggt | 5543 | VEGFA |
| 2 | ctaggggcgctcggccaccac | 5544 | VEGFA |
| 3 | tggctaaagagggaatgggctt | 5545 | VEGFA |
| 4 | cacacccggctctggctaaag | 5546 | VEGFA |

TABLE 3-continued

MG1-4 mammalian targeting sequences

| MG1-4 Target ID | MG1-4 Targeting Sequence | Targeting sequence SEQ ID NO: | Targeted Gene |
|---|---|---|---|
| 5 | tcggaggagccgtggtccgcgc | 5547 | VEGFA |
| 6 | gcggaccacggctcctccgaag | 5548 | VEGFA |
| 7 | gtacaaacggcagaagctggag | 5549 | EMX1 |
| 8 | gaggaagggcctgagtccgagca | 5550 | EMX1 |
| 9 | aaggcaaacatcctgataatgg | 5551 | Apolipoprotein |

TABLE 4

MG1-6 mammalian targeting sequences

| MG1-6 Target ID | MG1-6 Targeting Sequence | Targeting sequence SEQ ID NO: | Targeted Gene |
|---|---|---|---|
| 1 | tctttagccagagccggggtgt | 5552 | VEGFA |
| 2 | tggacccctatttctgacctc | 5553 | VEGFA |
| 3 | atgggagcccttcttcttctgc | 5554 | EMX1 |
| 4 | tgccacgaagcaggccaatggg | 5555 | EMX1 |
| 5 | tggtgtctgtttgaggttgcta | 5556 | HBB-R01 |
| 6 | gggcaggttggtatcaaggtta | 5557 | HBB-R01 |
| 7 | aggtgctgacgtaggtagtgct | 5558 | FANCF |
| 8 | gccctacttccgctttcacctt | 5559 | FANCF |
| 9 | aatgtatgctggcttttaaggg | 5560 | IVS40 |
| 10 | gctcctaggctagggaagtgt | 5561 | IVS40 |

Targeted Endonuclease Activity in Mammalian Cells (b)

Figure 37:
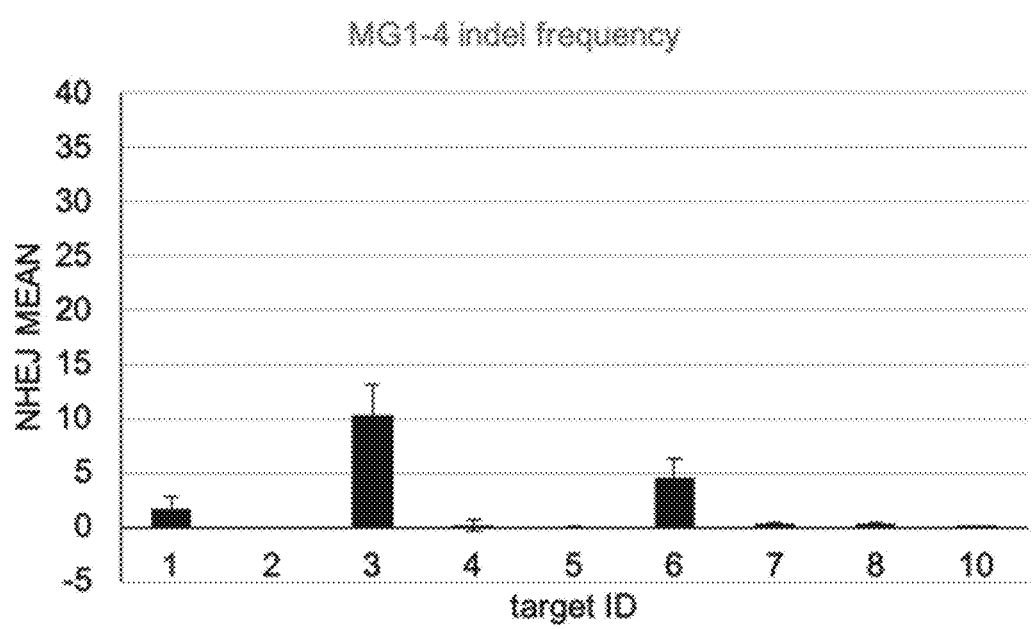
FIGS. 37-39 depicts in cell indel formation generated by transfection of HEK cells with MG1-4, MG1-6 and MG1-7 constructs described in Example 11 alongside their corresponding sgRNAs containing various different targeting sequences targeting various locations in the human genome.
Figure 38:
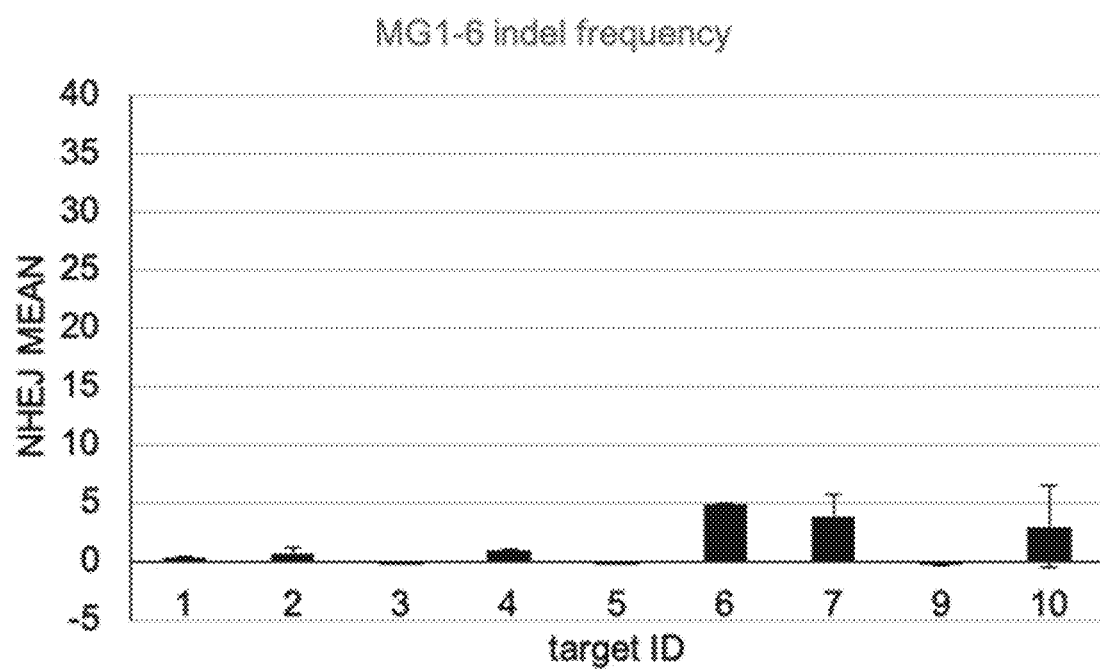

MG1-4 target loci were chosen to test locations in the genome with the PAM nRRRAA (SEQ ID NO: 5527). The spacers corresponding to the chosen target sites were cloned into the sgRNA scaffold in the mammalian vector system Backbone 2 described in Example 10b. The sites are listed in Table 4a below. The activity of MG1-4 at various target sites is shown in Table 4a and FIG. 37

TABLE 4a

Activity of MG1-4 at various target sites

| target ID | target sequence | PAM | locus | % NHEJ (mean ± std) |
|---|---|---|---|---|
| 1 | aatatgtagctgtttgggaggt | CAGAAA | VEGFA | 1.62 ± 1.2 |
| 2 | ctaggggcgctcggccaccac | AGGGAA | VEGFA | -0.07 ± 0 |
| 3 | tggctaaagagggaatgggctt | TGGAAA | VEGFA | 10.32 ± 2.75 |
| 4 | cacacccggctctggctaaag | AGGGAA | VEGFA | 0.18 ± 0.53 |
| 5 | tcggaggagccgtggtccgcgc | GGGGAA | VEGFA | 0 ± 0.03 |
| 6 | gaagccgagccgagcggagccg | CGAGAA | VEGFA | 4.53 ± 1.73 |
| 7 | gcggaccacggctcctccgaag | GAGGAA | VEGFA | 0.3 ± 0.04 |
| 8 | gtacaaacggcagaagctggag | GAAGAA | EMX1 | 0.23 ± 0.1 |
| 10 | Gaaggcaaacatcctgataatgg | TGAAAA | Apolipoprotein | 0.07 ± 0.06 |

MG1-6 target loci were chosen to test locations in the genome with the PAM nnRRAC (SEQ ID NO: 5529). The spacers corresponding to the chosen target sites were cloned into the sgRNA scaffold in the mammalian vector system backbone 2 described in Example 10b. The sites are listed in Table 4b below. The activity of MG1-6 at various target sites is shown in Table 4b and FIG. 38.

TABLE 4b

Activity of MG1-6 at various target sites.

| target ID | target sequence | PAM | locus | % NHEJ (mean ± std) |
|---|---|---|---|---|
| 1 | tctttagccagagccggggtgt | GCAGAC | VEGFA | 0.385 ± 0.035 |
| 2 | tggaccccctatttctgacctc | CCAAAC | VEGFA | 0.65 ± 0.62 |
| 3 | atgggagcccttcttcttctgc | TCGGAC | EMX1 | -0.045 ± 0.105 |
| 4 | tgccacgaagcaggccaatggg | GAGGAC | EMX1 | 0.96 ± 0.14 |
| 5 | tggtgtctgtttgaggttgcta | GTGAAC | HBB | -0.09 ± 0.09 |
| 6 | gggcaggttggtatcaaggtta | CAAGAC | HBB | 4.915 ± 0.135 |
| 7 | aggtgctgacgtaggtagtgct | TGAGAC | FANCF | 3.85 ± 1.86 |
| 9 | aatgtatgctggctittaaggg | GGAAAC | IVS40 | -0.215 ± 0.105 |
| 10 | gctcctttggctagggaagtgt | TAAAAC | IVS40 | 3.03 ± 03.5 |

Figure 39:
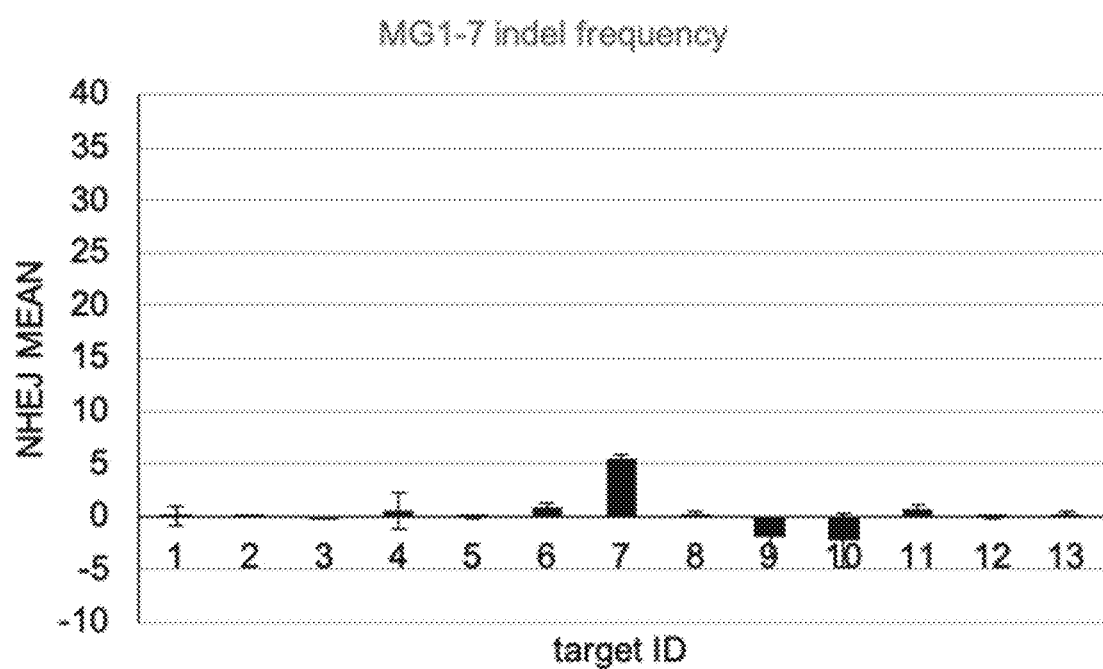

MG1-7 target loci were chosen to test locations in the genome with the PAM nRRRAAG (SEQ ID NO: 5515). The spacers corresponding to the chosen target sites were cloned into the sgRNA scaffold in the mammalian vector system backbone 2 described in Example 10b. The sites are listed in Table 4c below. The activity of MG1-7 at various target sites is shown in Table 4c and FIG. 39.

TABLE 4c

Activity of MG1-7 at various target sites

| target ID | target sequence | PAM | locus | % NHEJ (mean ± std) |
|---|---|---|---|---|
| 1 | atcaaactgtgagcatcttcag | ggaaaag | IVS40 | 0.105 ± 0.88 |
| 2 | cagcgaatctactcagccagag | caggaag | IVS40 | 0.075 ± 0.02 |

TABLE 4c-continued

Activity of MG1-7 at various target sites

| target ID | target sequence | PAM | locus | % NHEJ (mean ± std) |
|---|---|---|---|---|
| 3 | ctttaacttgtgtgattctgga | gaggaag | IVS40 | -0.25 |
| 4 | agcttaattagctcctttggct | agggaag | IVS40 | 0.545 ± 1.71 |
| 5 | ccatggtgcatctgactcctga | ggagaag | HBB | 0.005 ± 0.01 |
| 6 | tgcttgagaccgccagaagctc | ggaaaag | FANCF | 0.91 ± 0.38 |
| 7 | cgagaacagcccagaagttgga | cgaaaag | VEGFA | 5.49 ± 0.44 |
| 8 | cggaggagccgtggtccgcgcg | ggggaag | VEGFA | 0.27 ± 0.20 |
| 9 | atgtgtgagaaaaatttaatca | taagaag | Apolipoprotein | -1.85 ± 1.89 |
| 10 | aggtccaagtaaaatttgtctt | agaaaag | Apolipoprotein | -2.17 ± 2.55 |
| 11 | gtacaaacggcagaagctggag | gaggaag | EMX1 | 0.775 ± 0.33 |
| 12 | aggaagggcctgagtccgagca | gaagaag | EMX1 | 0.01 ± 0.01 |
| 13 | aagggcctgagtccgagcagaa | gaagaag | EMX1 | 0.185 ± 0.22 |

Example 12.—Characterization of MG2 Family Members

PAM Specificity, tracrRNA/sgRNA Validation

The targeted endonuclease activity of MG2 family members was confirmed in the myTXTL system as described in Example 6. Results of this assay are shown in FIGS. 17-20. In the assay shown in FIGS. 17-20, active proteins that successfully cleave the library result in a band around 170 bp in the gel. Amplification products were observed for MG2-1 (see gel 2 lane 11 and gel 4 lane 6) and MG2-7 (see gel 11 lane 10) (SEQ ID NOs: 320 and 321, respectively). Sequencing the PCR products revealed active PAM sequences in Table 5 below:

TABLE 5

PAM sequence specificities and related data for MG2 enzymes

| Enzyme | Enzyme protein SEQ ID NO | Native (dual guide) PAM | PAM SEQ ID NO: | tracrRNA SEQ ID NO: | sgRNA SEQ ID NO: | Synthetic (single guide) PAM | Synthetic (single guide) PAM SEQ ID NO: |
|---|---|---|---|---|---|---|---|
| MG2-1 | 320 | nRCGTA | 5531 | 5490 | N/A | N/A | N/A |
| MG2-7 | 321 | N/A | N/A | 5491 | 5465 | NNNRTA | 5516 |

Targeted Endonuclease Activity in Bacterial Cells

In vivo activity of the MG2-7 endonuclease system with a sgRNA (endonuclease SEQ ID NO: 321; sgRNA SEQ ID NO: 5465) and an AGCGTAAG PAM sequence was confirmed using the method described in Example 9. Transformed *E. coli* were plated in serial dilution, and the results (showing *E. coli* serial dilutions in the left panel and quantitated growth in the right panel) are presented in FIG. 34. A substantial reduction in the growth of *E. coli* expressing on target sgRNA compared to *E. coli* expressing non-target sgRNA indicates that genomic DNA was specifically cleaved by the MG1-4 endonuclease in *E. coli* cells.

Example 13.—Characterization of MG3 Family Members

PAM Specificity, tracrRNA/sgRNA Validation

The targeted endonuclease activity of MG3 family members was confirmed using the myTXTL system as described in Example 6 using tracr sequences and CRISPR arrays. In this assay, PCR amplification of cleaved target plasmids yields a product that migrates at approximately 170 bp in the gel, as shown in FIGS. 17-20. Amplification products were observed for MG3-6 (dual guide: see gel 2 lane 8; single guide: see gel 3 lane 3), MG3-7 (dual guide: see gel 2 lane 3, single guide: see gel 3 lane 4), and MG3-8 (dual guide: see gel 9 lane 5) (SEQ ID NOs: 421, 422, and 423, respectively). Sequencing the PCR products revealed active PAM sequences in Table 6 below:

TABLE 6

PAM sequence specificities and related data for MG3 enzymes

| Enzyme | Enzyme protein SEQ ID NO | Native (dual guide) PAM | PAM SEQ ID NO: | tracrRNA SEQ ID NO: | sgRNA SEQ ID NO: | Synthetic (single guide) PAM | Synthetic (single guide) PAM SEQ ID NO: |
|---|---|---|---|---|---|---|---|
| MG3-6 | 421 | nnRGGTT | 5532 | 5500 | 5466 | nnGGG | 5517 |
| MG3-7 | 422 | nnRnYAY | 5533 | 5501 | 5467 | nnGnTnT | 5518 |
| MG3-8 | 423 | nnRGGTT | 5534 | 5502 | N/A | N/A | N/A |

Synthetic single guide RNAs (sgRNAs) were designed based on the sequences and predicted structures of the tracrRNAs and are presented as SEQ ID NOs: 5466-5467. The PAM sequence screen of Example 6 was repeated with the sgRNAs. The results of this experiment are also presented in Table 6, which reveals that PAM specificity changed slightly when using sgRNAs.

Targeted Endonuclease Activity In Vitro

Figure 13:
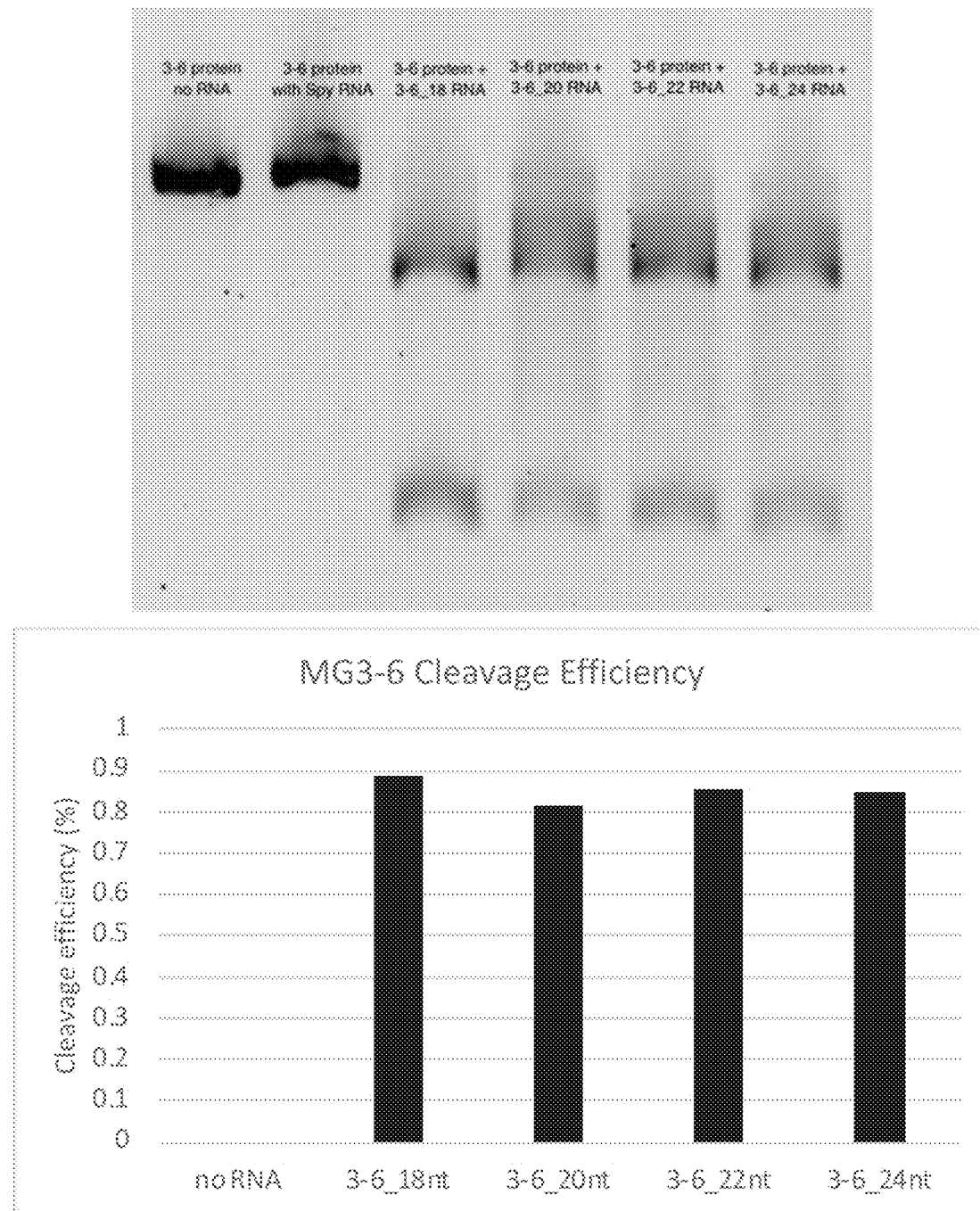
FIG. 13 depicts vitro cleavage of DNA by MG3-6 in complex with its corresponding sgRNA containing targeting sequences of varying lengths.

In vitro activity of the MG3-6 (endonuclease SEQ ID NO: 421) was verified with the PAM sequence GTGGGTTA using the method of Example 8. The single guide sequence reported above (SEQ ID NO: 5466) was used, with varying spacer/targeting sequence lengths from 18-24 nt replacing the Ns of the sequence. The results are shown in FIG. 13, wherein the top panel shows a gel demonstrating DNA cleavage by MG3-6 in combination with different sgRNAs having different targeting sequence lengths (18-24nt), and the bottom panel shows the same data quantified as a bar graph. The data demonstrated that targeting sequences from 18-24 nucleotides were functional with the MG3-6/sgRNA system.

Targeted Endonuclease Activity in Bacterial Cells

Figure 14:
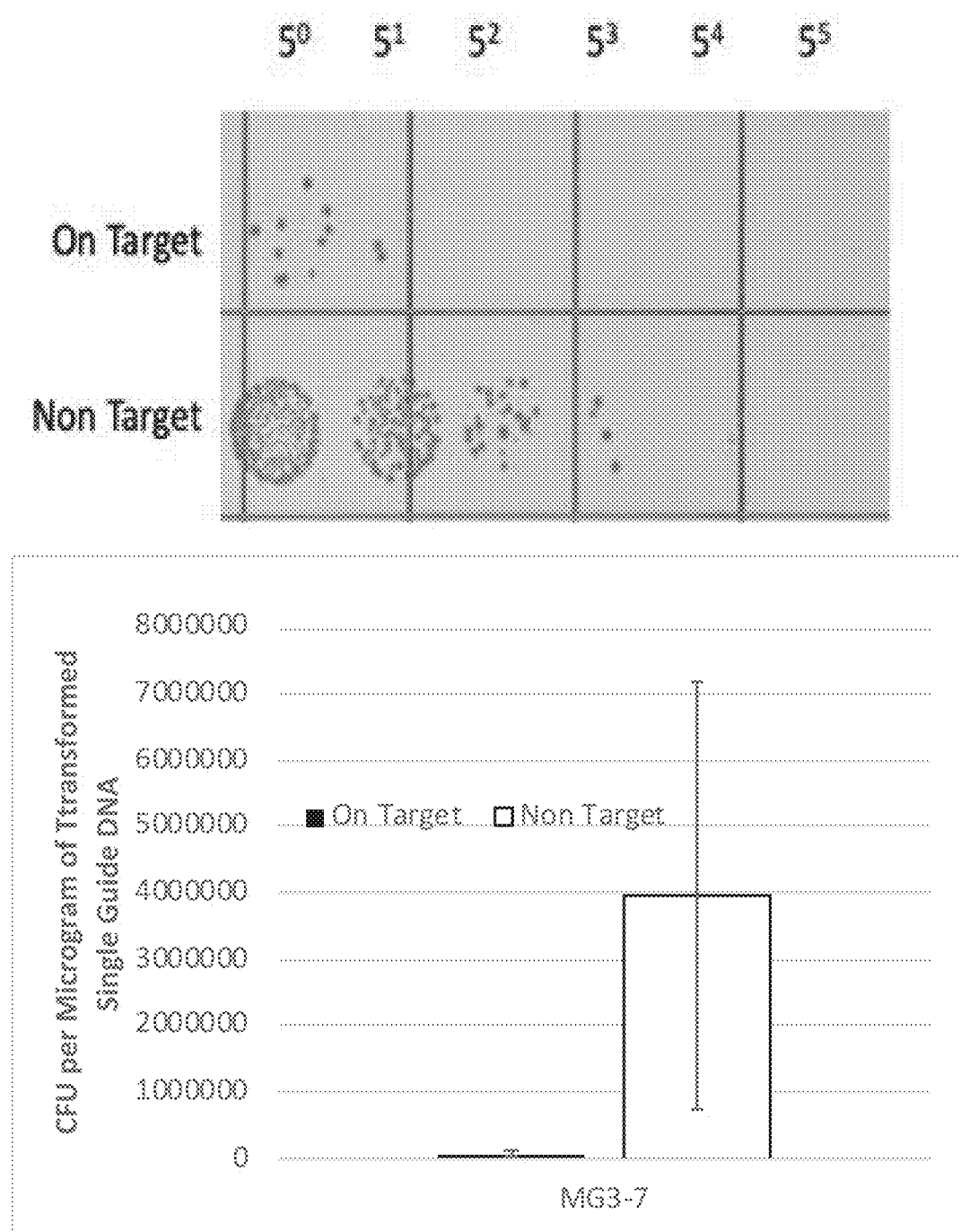
FIG. 14 depicts in cell cleavage of *E. coli* genomic DNA using MG3-7 along with its corresponding sgRNA. Shown are dilution series of cells transformed with MG3-7 along with target or non-target spacer (top); bottom panel shows the data quantitated, where the left bar represents non-target sgRNA and the right bar represents target sgRNA.

In vivo activity of the MG3-7 endonuclease system (protein SEQ ID NO: 422; sgRNA SEQ ID NO: 5467) was tested with the PAM sequence TGGACCTG using the method of Example 9. Transformed E. coli were plated in serial dilution, and the results (showing E. coli serial dilutions in the top panel and quantitated growth in the bottom panel) are presented in FIG. 14. A substantial reduction in the growth of E. coli expressing on target sgRNA compared to E. coli expressing non-target sgRNA indicates that genomic DNA was being specifically cleaved by the MG3-7 endonuclease system.

Targeted Endonuclease Activity in Mammalian Cells (a)

Figure 15:
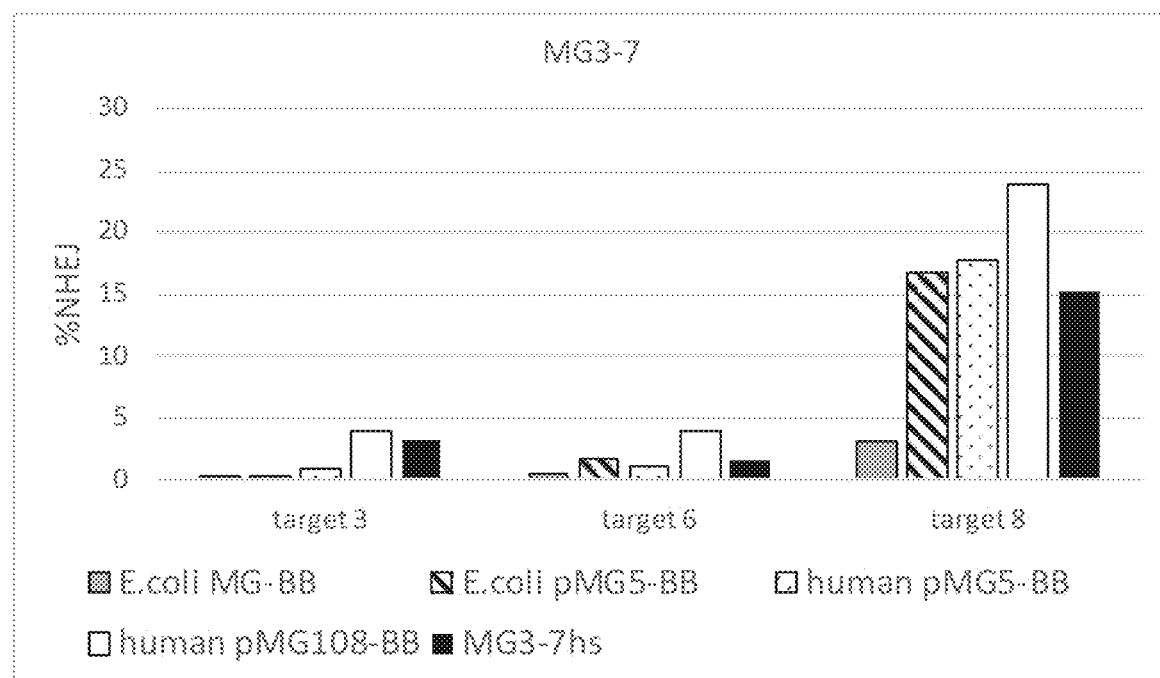
FIG. 15 depicts in cell indel formation generated by transfection of HEK cells with MG3-7 constructs described in Example 13 alongside their corresponding sgRNAs containing various different targeting sequences targeting various locations in the human genome.

The method of Example 10 was used to demonstrate targeting and cleavage activity in mammalian cells. Open reading frames encoding MG3-7 (protein SEQ ID NO: 422) was cloned into 2 mammalian expression vectors, one with a C-terminal SV40 NLS and a 2A-GFP tag (E. coli MG-BB) and one with no GFP tag and 2 NLS sequences, one on the N-terminus and one on the C-terminus (E. coli pMG5-BB). The endonuclease expression vectors were cotransfected into HEK293T cells with a second vector for expressing the sgRNA above with a guide sequence selected from Table 7. The results of this experiment are shown in FIG. 12. 72 hr after co-transfection DNA was extracted and used for the preparation of an NGS-library. Cleavage activity was detected by the appearance of internal deletions (NHEJ remnants) in the vicinity of the target site. Results are presented in FIG. 15.

The target site which were encoded on the sgRNA plasmids are shown in Table 7 below.

TABLE 7

MG3-7 mammalian targeting sequences

| MG3-7 Target ID | MG3-7 Targeting Sequence | Targeting sequence SEQ ID NO: | Targeted Gene |
|---|---|---|---|
| 1 | ccctatttctgacctcccaaa | 5563 | VEGFA |
| 2 | tgtggttccagaaccggaggac | 5564 | EMX1 |
| 3 | ggccctgggcaggttggtatca | 5565 | HBB-R01 |
| 4 | tccttaaacctgtcttgtaacc | 5566 | HBB-R01 |
| 5 | ctgactcctgaggagaagtctg | 5567 | HBB-R01 |
| 6 | tccgagcttctggcggtctcaa | 5568 | FANCF |
| 7 | tatcatttcgcggatgttccaa | 5569 | FANCF |
| 8 | tcgggcagagggtgcatcacct | 5570 | Apolipoprotein |
| 9 | ataataagcagaactttagtg | 5571 | Fibrinogen |
| 10 | gttttctttagttattaatttc | 5572 | Fibrinogen |

Targeted Endonuclease Activity in Mammalian Cells (b)

Figure 40:
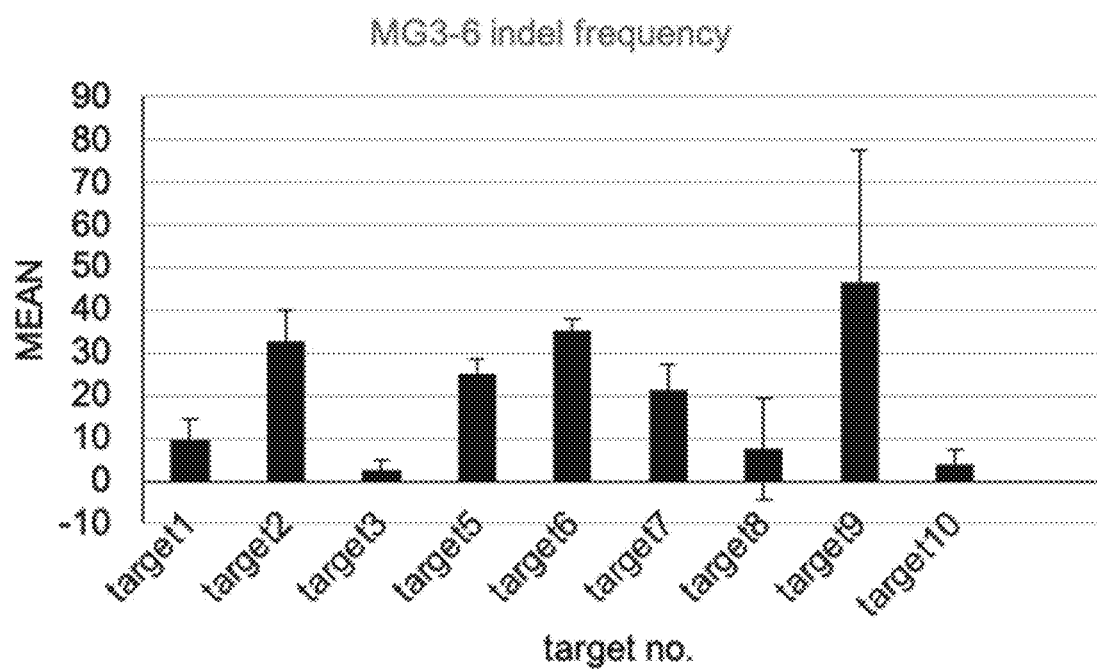
FIGS. 40-42 depicts in cell indel formation generated by transfection of HEK cells with MG3-6, MG3-7 and MG3-8 constructs described in Example 13 alongside their corresponding sgRNAs containing various different targeting sequences targeting various locations in the human genome.

MG3-6 target loci were chosen to test locations in the genome with the PAM nnRGGTT (SEQ ID NO: 5532). The spacers corresponding to the chosen target sites were cloned into the sgRNA scaffold in the mammalian vector system backbone 1 described in Example 10b. The sites are listed in Table 7a below. The activity of MG3-6 at various target sites is shown in Table 7a and FIG. 40.

TABLE 7a

Activity of MG3-6 at various target sites

| target ID | target sequence | PAM | locus | % NHEJ (mean ± std) |
|---|---|---|---|---|
| target1 | gagtgactgaaacttcacagaa | tagggtt | Albumin | 9.755 ± 4.67 |
| target2 | ttctatttatgagatcaacagc | acaggtt | Albumin | 32.75 ± 7.42 |
| target3 | cagatgcaccatggtgtctgtt | tgaggt | HBB_R01 | 2.525 ± 2.13 |
| target5 | gaggccctgggcaggttggtat | caaggtt | HBB_R01 | 25.16 ± 3.67 |
| target6 | aggttggtatcaaggttacaag | acaggtt | HBB_R01 | 35.27 ± 2.78 |
| target7 | tcaactttcctggcaacttgcg | gtaggtt | Apolipoprotei | 21.57 ± 5.70 |
| target8 | aggaacattcagttaagatagt | ctaggtt | Fibrinogen | 7.5675 ± 11.99 |
| target9 | tttaaattatgaatccatctct | aaaggtt | Fibrinogen | 46.3175 ± 31.46 |
| target10 | gagtgactgaaacttcacagaa | tagggtt | Albumin | 3.9325 ± 3.53 |

Figure 41:
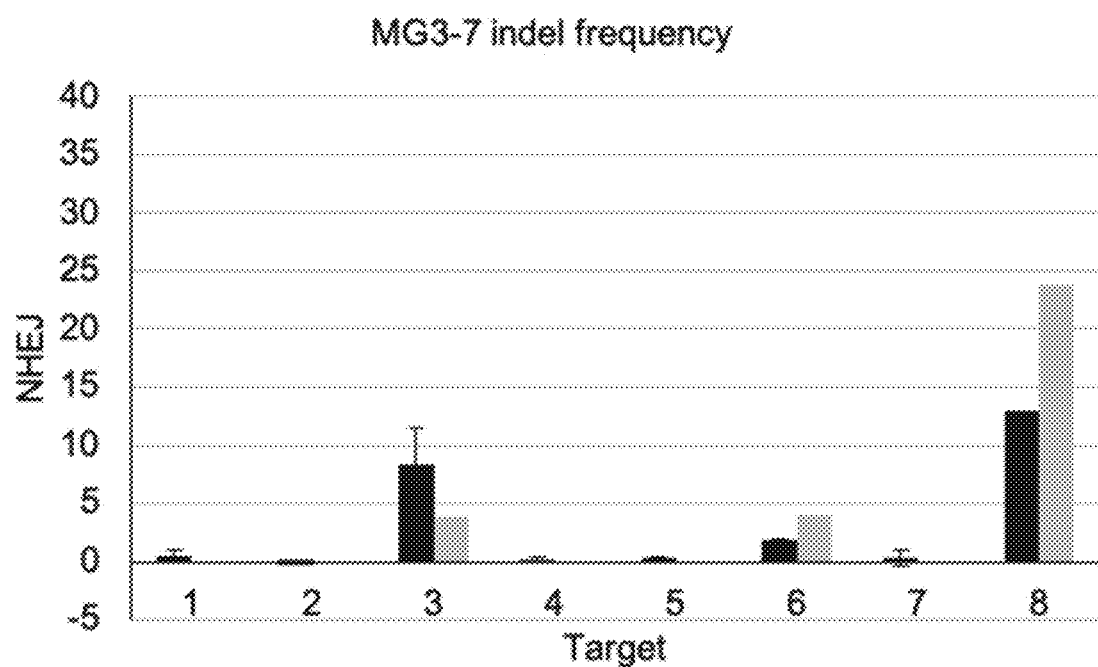

MG3-7 target loci were chosen to test locations in the genome with the PAM nnRnTAC (SEQ ID NO: 5718). The spacers corresponding to the chosen target sites were cloned into the sgRNA scaffold in the mammalian vector systems described in Example 10b. The sites are listed in Table 7b below. The activity of MG3-7 at various target sites is shown in Table 7b and FIG. 41.

TABLE 7b

Activity of MG3-7 at various target sites

| target ID | target sequence | PAM | locus | % NHEJ backbone 2 (mean ± std) | % NHEJ backbone 1 |
|---|---|---|---|---|---|
| 1 | ccccctatttctgacctcccaaa | CAGCTAC | VEGFA | 0.54 ± 0.44 | |
| 2 | tgtggttccagaaccggaggac | AAAGTAC | EMX1 | -0.09 ± 0.04 | |
| 3 | ggccctgggcaggttggtatca | AGGTTAC | HBB | 8.275 ± 0.3.12 | 3.87 |
| 4 | tccttaaacctgtcttgtaacc | TTGATAC | HBB | 0.16 ± 0.20 | |
| 5 | ctgactcctgaggagaagtctg | CCGTTAC | HBB | 0.245 ± 0.16 | |
| 6 | tccgagcttctggcggtctcaa | GCACTAC | FANCF | 1.84 ± 0.10 | 3.95 |
| 7 | tatcatttcgcggatgttccaa | TCAGTAC | FANCF | 0.325 ± 0.68 | |
| 8 | tcgggcagagggtgcatcacct | GGACTAC | Apolipo-protein | 13 | 23.88 |

Figure 42:
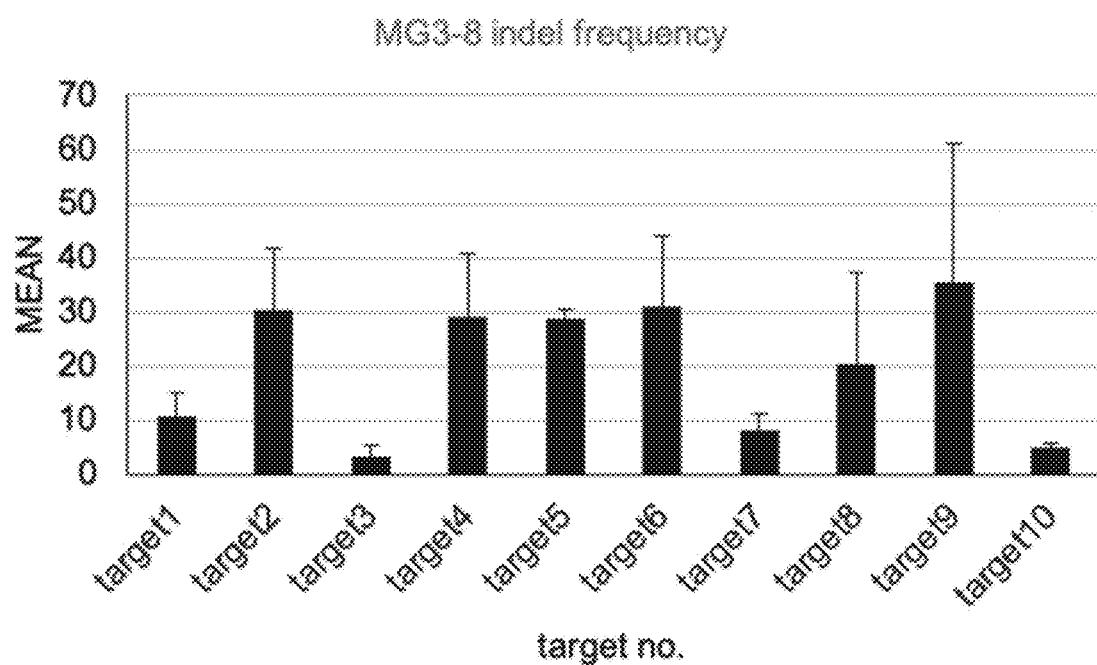

MG3-8 target loci were chosen to test locations in the genome with the PAM nnRGGTT (SEQ ID NO: 5534). The spacers corresponding to the chosen target sites were cloned into the sgRNA scaffold in the mammalian vector system backbone 1 described in Example 10b. The sites are listed in Table 7c below. The activity of MG3-8 at various target sites is shown in Table 7c and FIG. 42.

TABLE 7c

Activity of MG3-8 at various target sites

| target ID | target sequence | PAM | locus | % NHEJ (mean ± std) |
|---|---|---|---|---|
| target1 | gagtgactgaaacttcacagaa | tagggtt | Albumin | 10.81 ± 4.26 |
| target2 | ttctatttatgagatcaacagc | acaggtt | Albumin | 30.48 ± 11.17 |

TABLE 7c-continued

Activity of MG3-8 at various target sites

| target ID | target sequence | PAM | locus | % NHEJ (mean ± std) |
|---|---|---|---|---|
| target3 | cagatgcaccatggtgtctgtt | tgaggt | HBB | 3.3925 ± 2.13 |
| target4 | gaagttggtggtgaggccctgg | gcaggtt | HBB | 28.995 ± 11.87 |
| target5 | gaggccctgggcaggttggtat | caaggtt | HBB | 28.69 ± 1.96 |
| target6 | aggttggtatcaaggttacaag | acaggtt | HBB | 30.8575 ± 13.24 |
| target7 | tcaactttcctggcaacttgcg | gtaggtt | Apolipoprotein | 7.9825 ± 3.23 |
| target8 | aggaacattcagttaagatagt | ctaggtt | Fibrinogen | 20.2925 ± 17.10 |
| target9 | tttaaattatgaatccatctct | aaaggtt | Fibrinogen | 35.533 ± 25.46 |
| target10 | gagtgactgaaacttcacagaa | tagggtt | Albumin | 4.9 ± 0.71 |

Example 13.—Characterization of MG4 Family Members

PAM Specificity, tracrRNA/sgRNA Validation

The targeted endonuclease activity of MG4 family endonuclease systems was confirmed using the myTXTL system as described in Example 6. In this assay, PCR amplification of cleaved target plasmids yields a product that migrates at approximately 170 bp in the gel, as shown in FIGS. 17-20. Amplification products were observed for, MG4-2 (dual guide: see gel2 lane 9, single guide: see gel 10 lane 7) (SEQ ID NO: 432). Sequencing the PCR products revealed active PAM sequences shown in Table 8 below.

TABLE 8

PAM sequence specificities and related data for MG4 enzymes

| Enzyme | Enzyme protein SEQ ID NO | tracrRNA SEQ ID NO: | sgRNA SEQ ID NO: | Synthetic (single guide) PAM | Synthetic (single guide) PAM SEQ ID NO: |
|---|---|---|---|---|---|
| MG4-5 | 432 | 5503 | 5468 | nnCCR | 5519 |

Example 14.—Characterization of MG14 Family Members

PAM Specificity, tracrRNA/sgRNA Validation

The targeted endonuclease activity of MG14 family members (was confirmed using the myTXTL system as described in Example 6. In this assay, PCR amplification of cleaved target plasmids yields a product that migrates at approximately 170 bp in the gel, as shown in FIGS. 17-20. Amplification products were observed for MG14-1 (dual guide: see gel 1 lane 4, single guide: see gel 3 lane 8) (SEQ ID NO: 678). Sequencing the PCR products revealed active PAM sequence specificities shown in Table 9 below.

TABLE 9

PAM sequence specificities and related data for MG14 enzymes

| Enzyme | Enzyme protein SEQ ID NO | Native (dual guide) PAM determined | PAM SEQ ID NO: | tracrRNA SEQ ID NO: | sgRNA SEQ ID NO: | Synthetic (single guide) PAM determined | Synthetic (single guide) PAM SEQ ID NO: |
|---|---|---|---|---|---|---|---|
| MG14-1 | 678 | NNNNGGTA | 5535 | 5505 | 5469 | NNNGGRTA | 5520 |

Targeted Endonuclease Activity in Bacterial Cells

In vivo activity of the MG14-1 endonuclease system with a sgRNA (endonuclease SEQ ID NO: 678; sgRNA SEQ ID NO: 5469) and a GGCGGGGA PAM sequence was confirmed using the method described in Example 9. Transformed E. coli were plated in serial dilution, and the results (showing E. coli serial dilutions in the left panel and quantitated growth in the right panel) are presented in FIG. 35. A substantial reduction in the growth of E. coli expressing on target sgRNA compared to E. coli expressing non-target sgRNA indicates that genomic DNA was specifically cleaved by the MG1-4 endonuclease in E. coli cells.

Targeted Endonuclease Activity in Mammalian Cells

Figure 43:
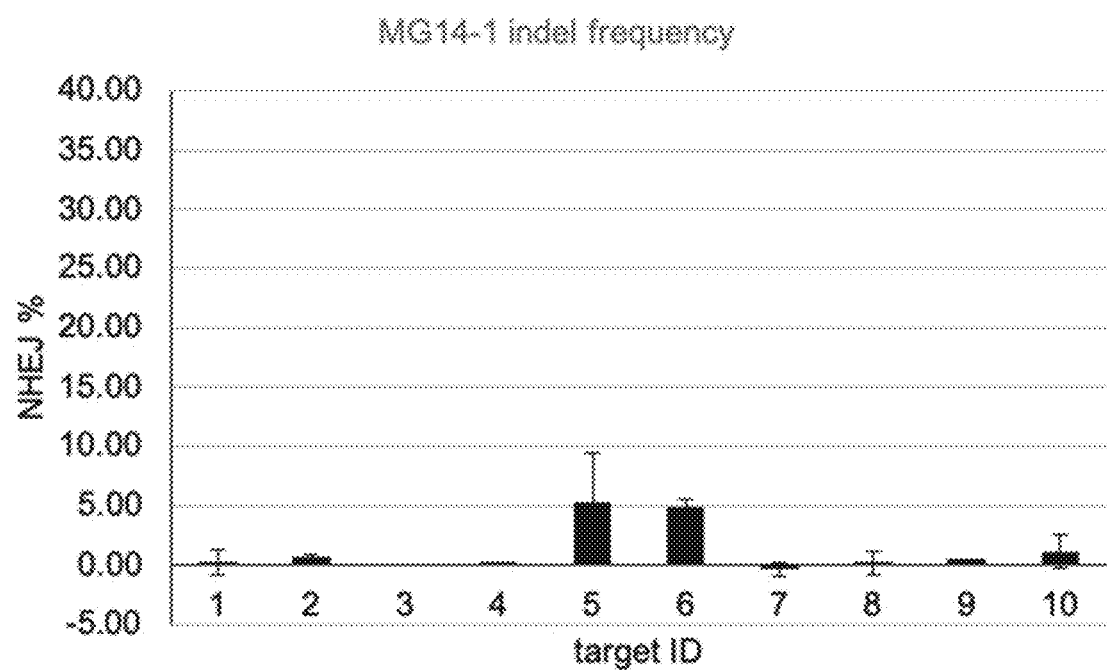
FIG. 43 depicts in cell indel formation generated by transfection of HEK cells with MG14-1 constructs described in Example 14 alongside their corresponding sgRNAs containing various different targeting sequences targeting various locations in the human genome.

MG14-1 target loci were chosen to test locations in the genome with the PAM nnnnGGTA (SEQ ID NO: 5535). The spacers corresponding to the chosen target sites were cloned into the sgRNA scaffold in the mammalian vector system backbone 2 described in Example 10b. The sites are listed in Table 9a below. The activity of MG14-1 at various target sites is shown in Table 9a and FIG. 43.

In Vitro Activity

Figure 16:
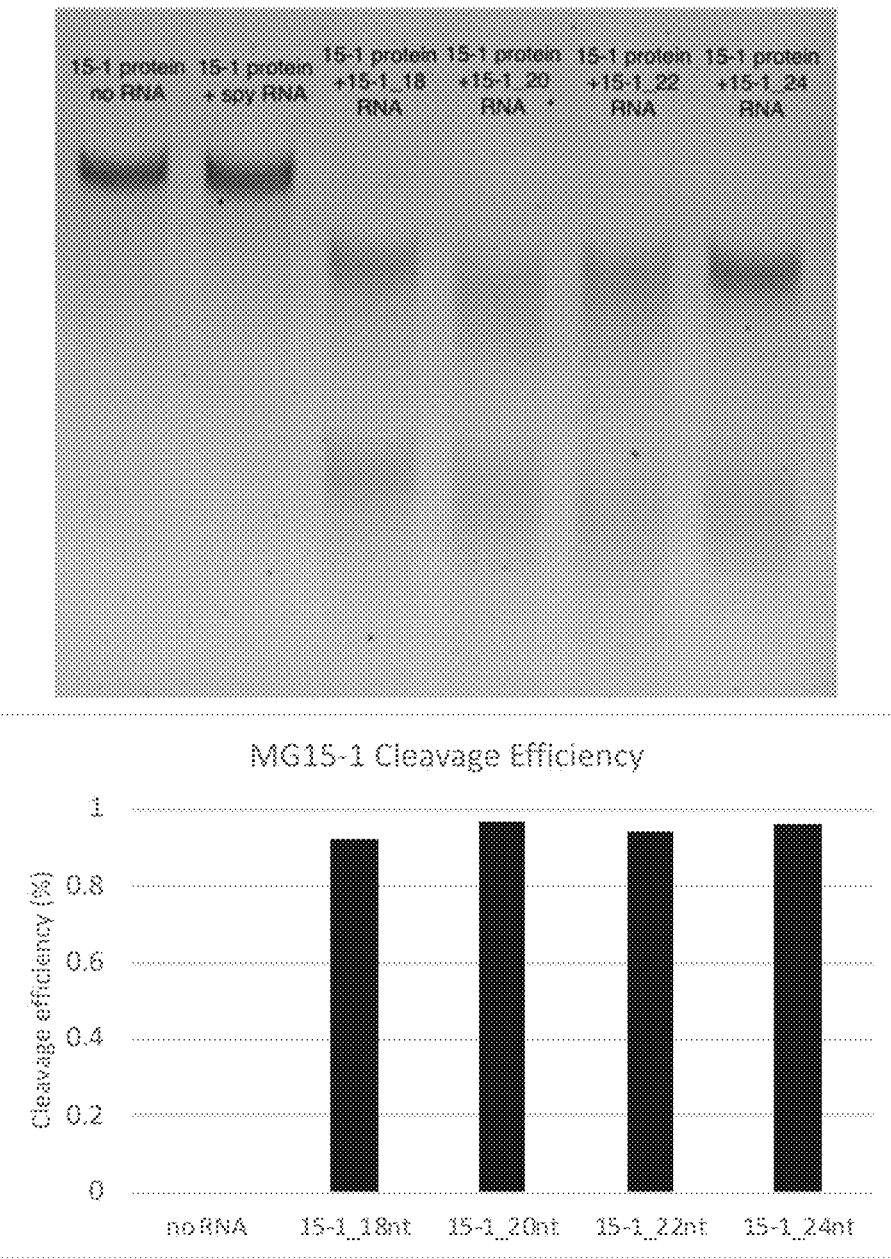
FIG. 16 depicts in vitro cleavage of DNA by MG15-1 in complex with its corresponding sgRNA containing targeting sequences of varying lengths.
Figure 17:
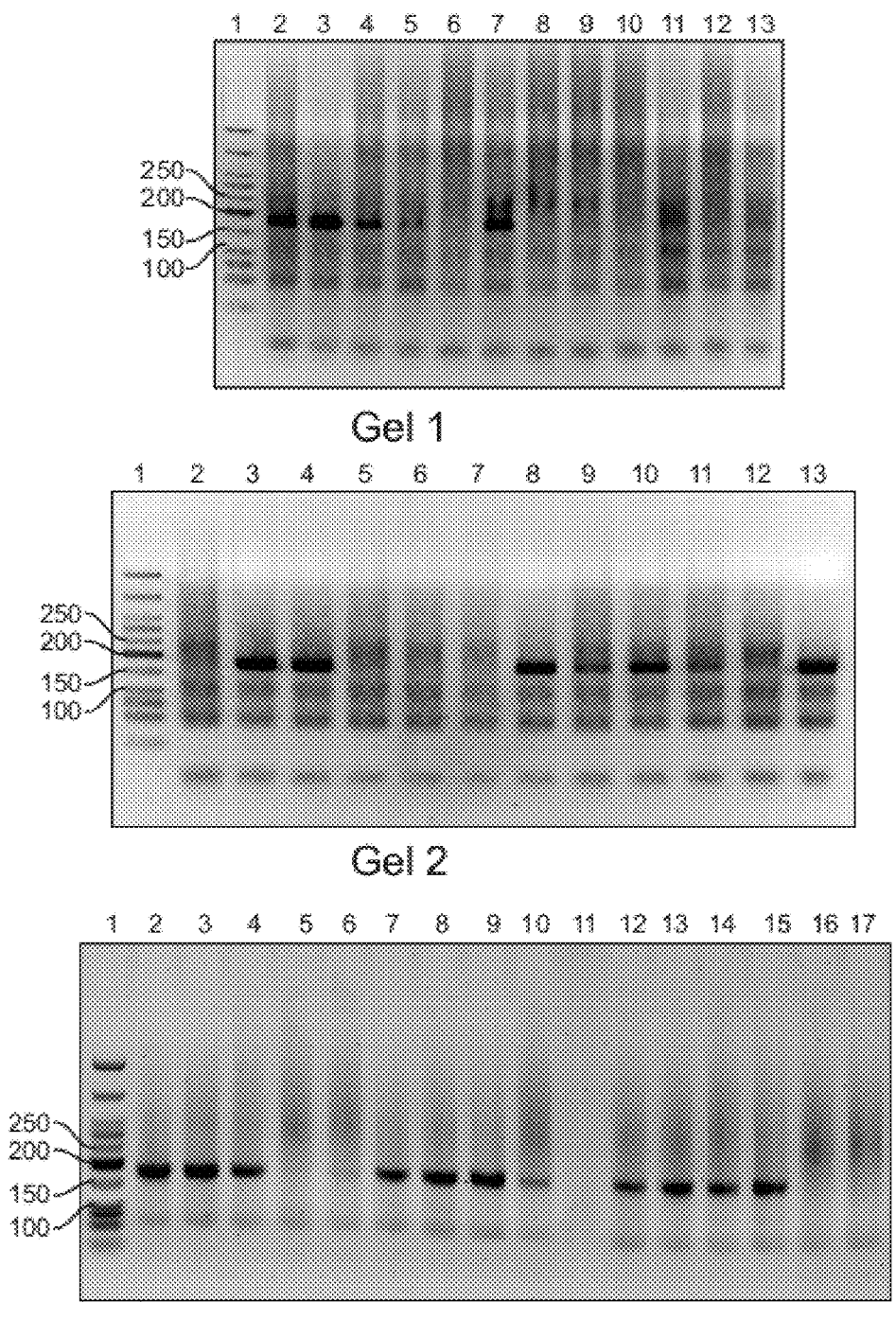
FIGS. 17, 18, 19, and 20 depict agarose gels showing the results of PAM vector library cleavage in the presence of TXTL extracts containing various MG family nucleases and their corresponding tracrRNAs or sgRNAs.
Figure 18:
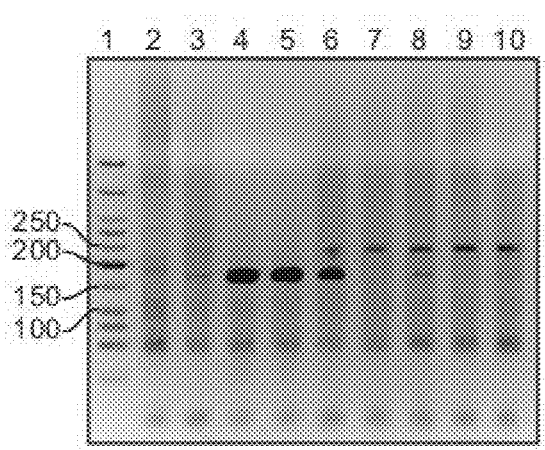
Figure 18:
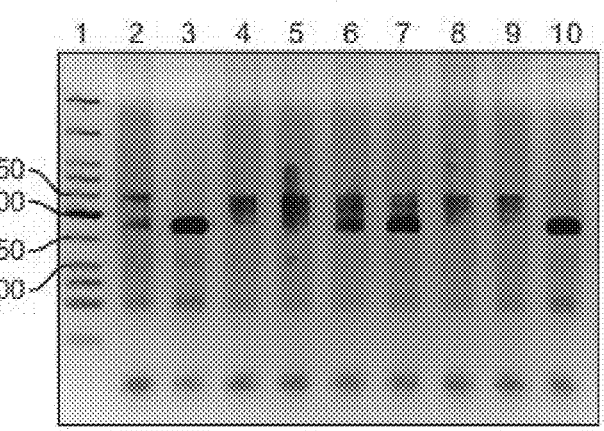
Figure 18:
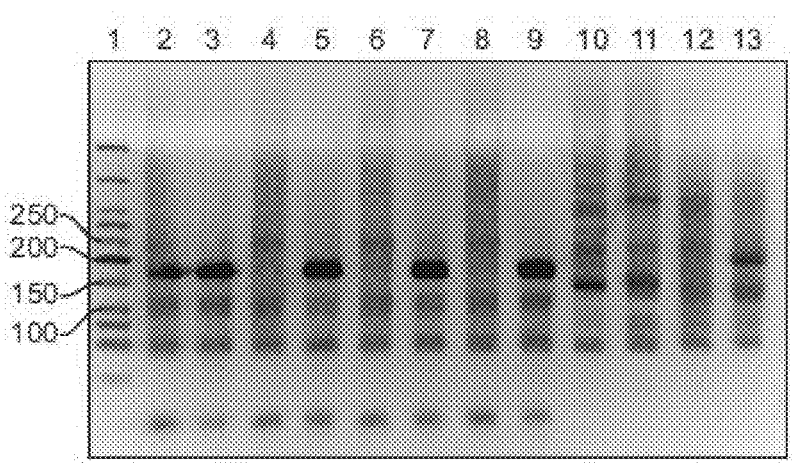
Figure 19:
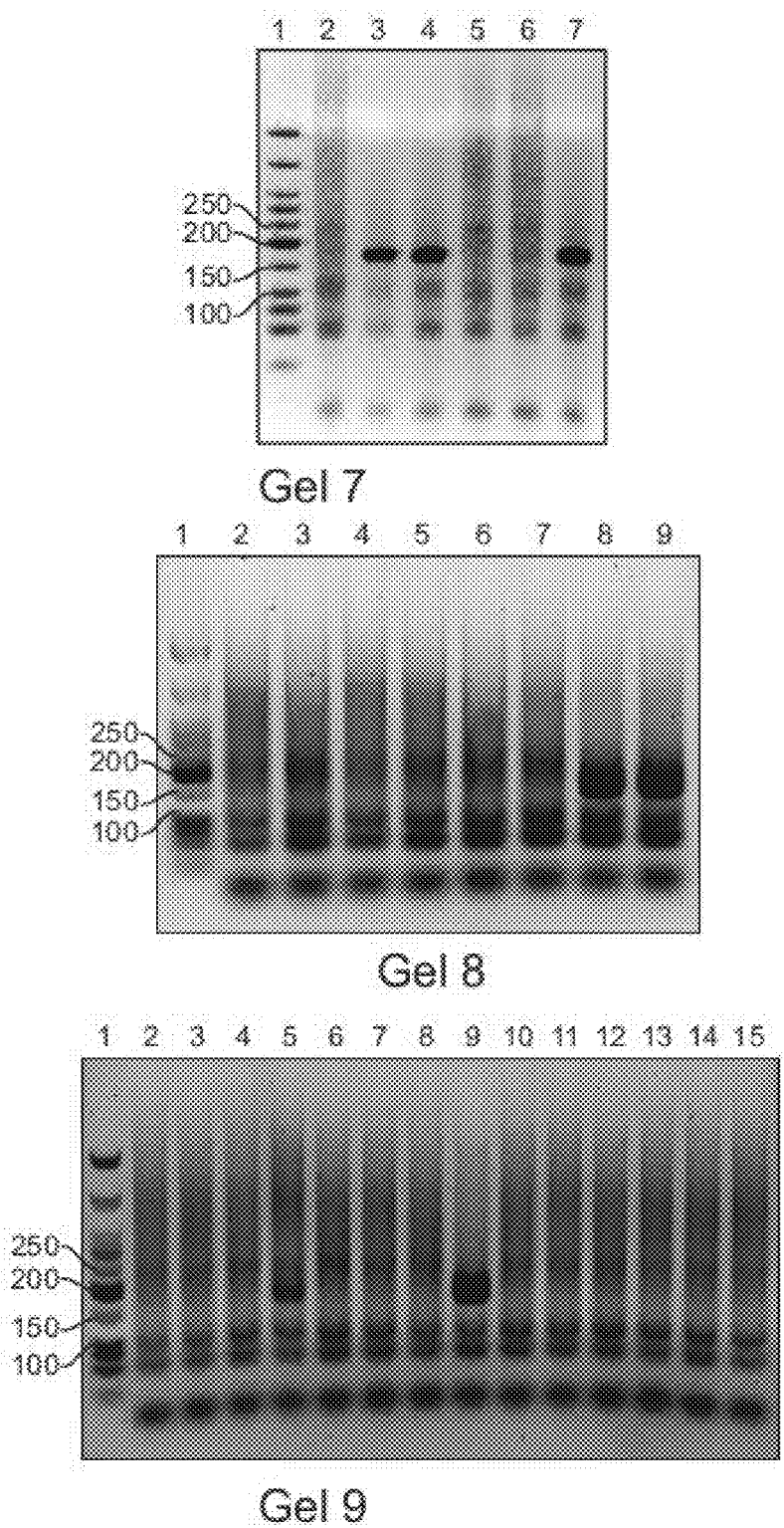
Figure 20:
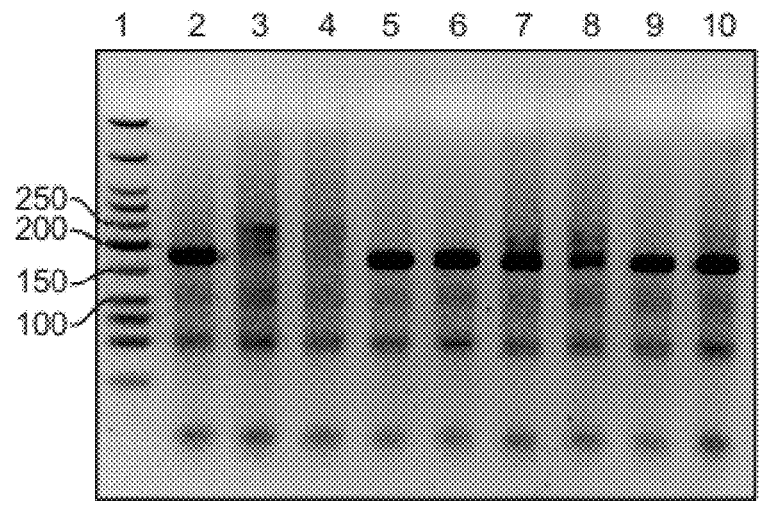
Figure 20:
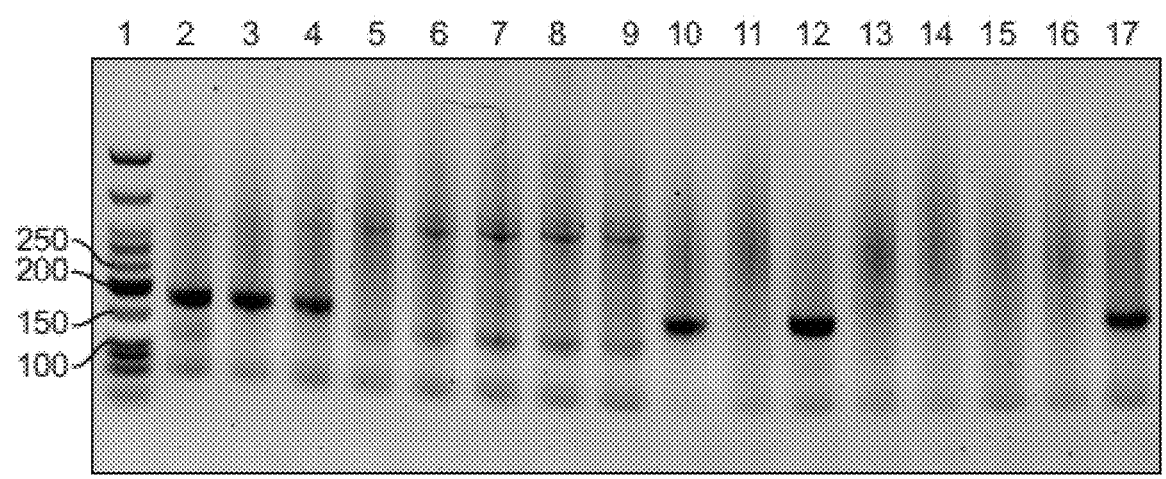
Figure 21:
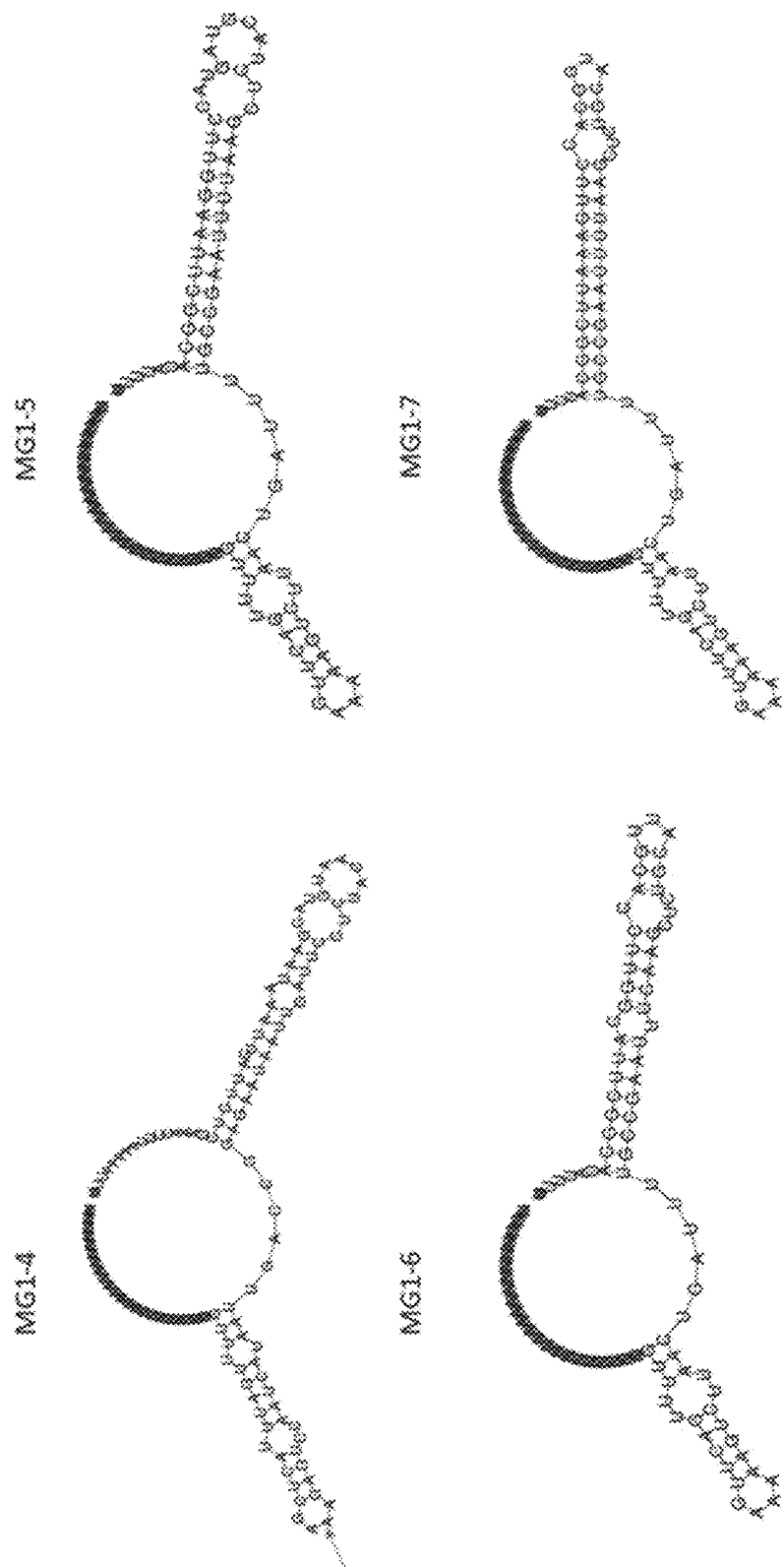
FIGS. 21, 22, 23, 24, 25 and 26 depict predicted structures (predicted e.g., as in Example 7) of corresponding sgRNAs of MG enzymes described herein.
Figure 22:
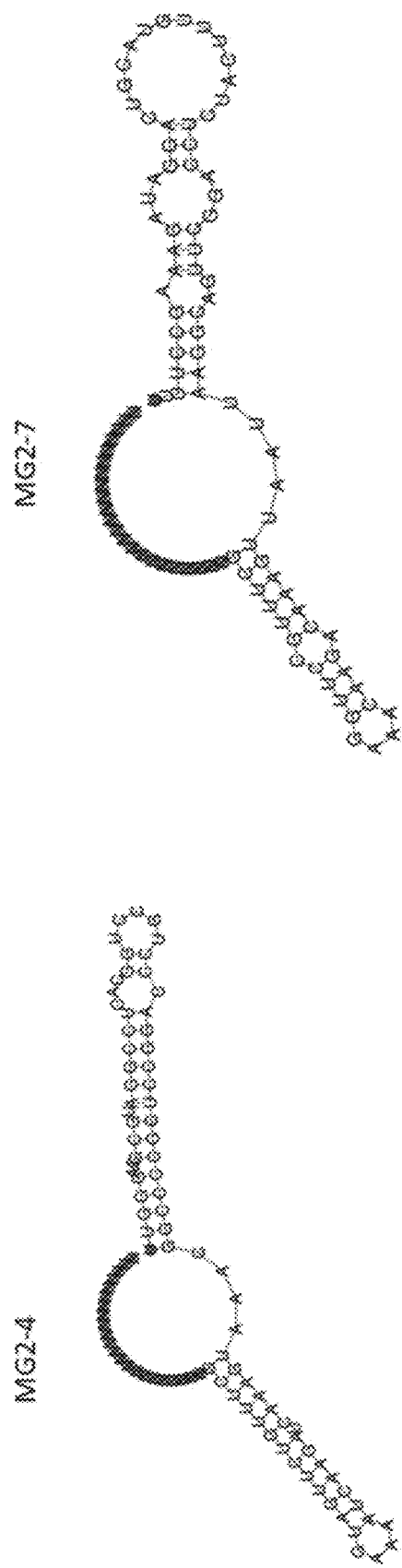
Figure 23:
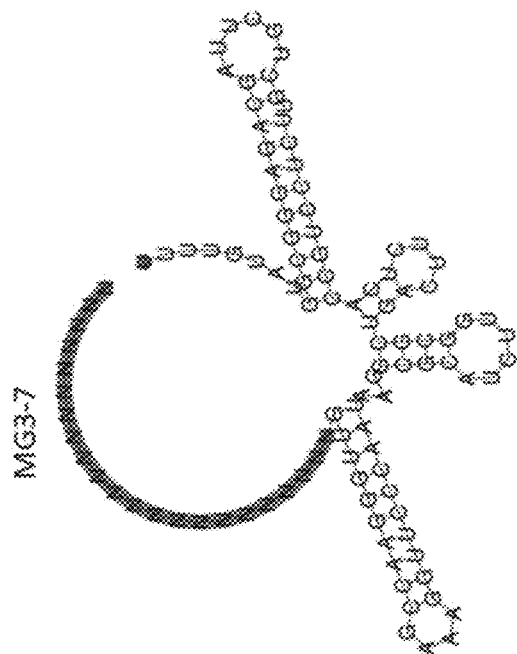
Figure 23:
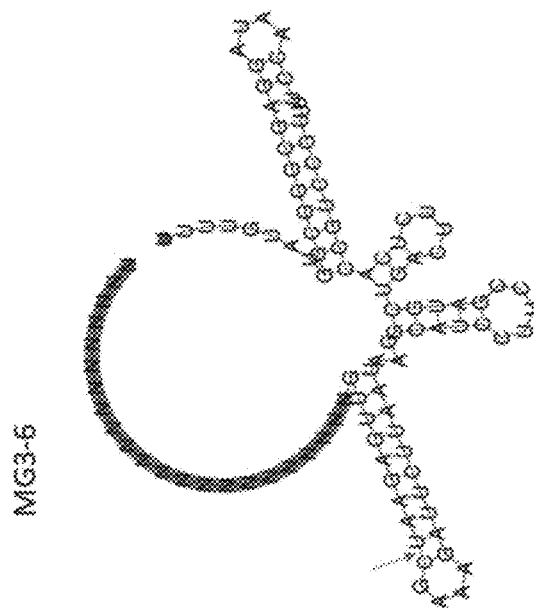
Figure 24:
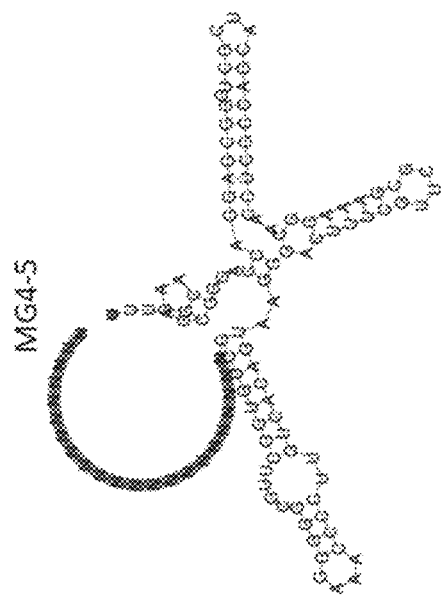
Figure 24:
Figure 25:
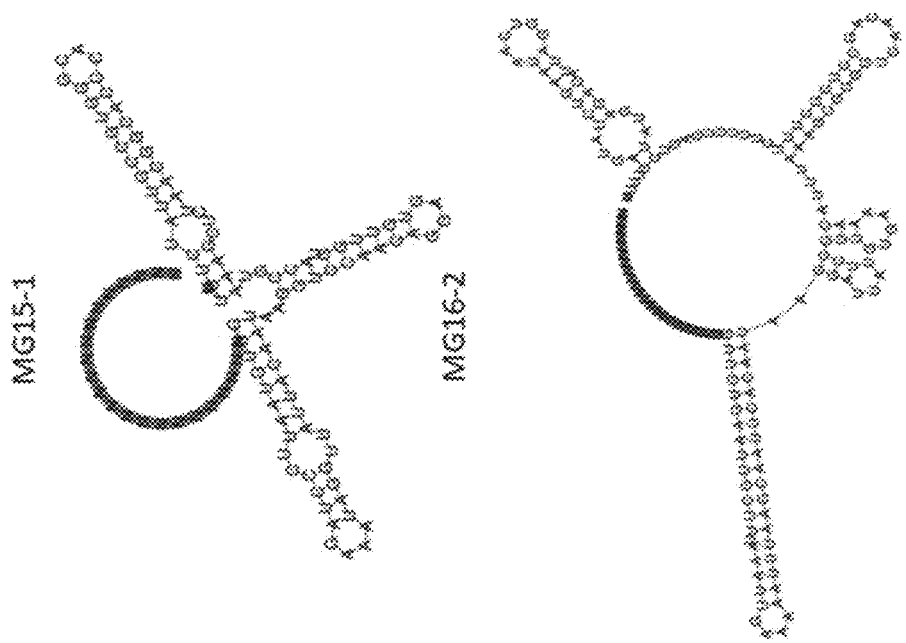
Figure 25:
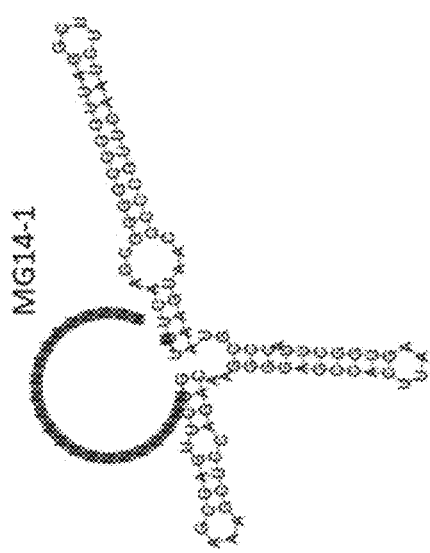
Figure 26:
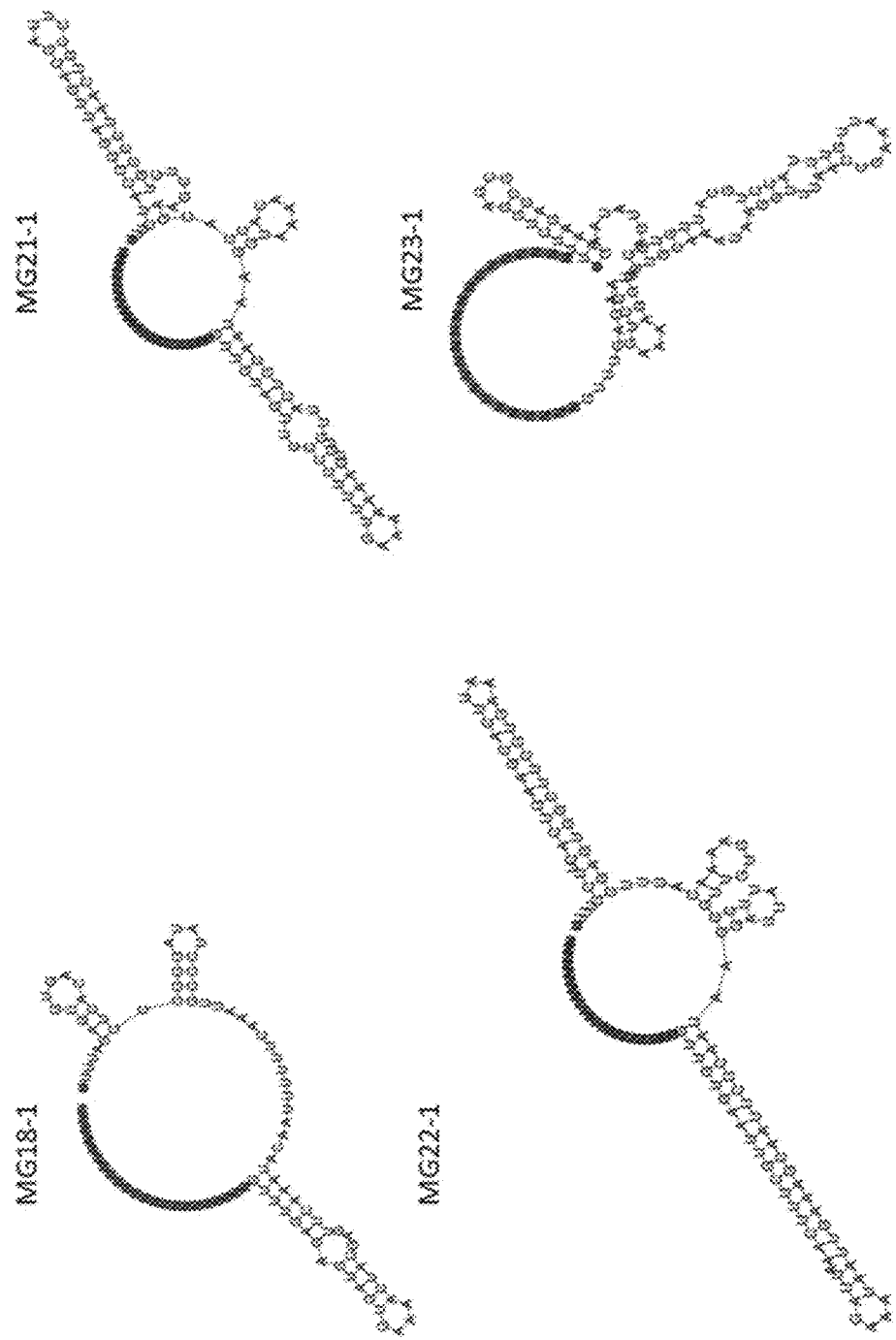
Figure 27:
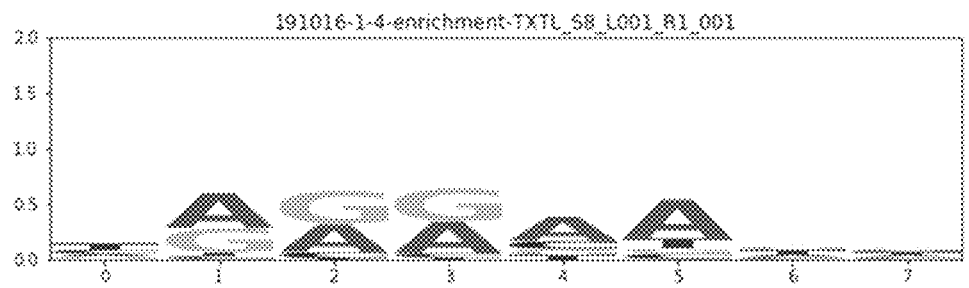
FIGS. 27, 28, 29, 30, 31, 32 and 33 depict seqLogo representations of PAM sequences derived via NGS as described herein (e.g. as described in Example 6).
Figure 27:
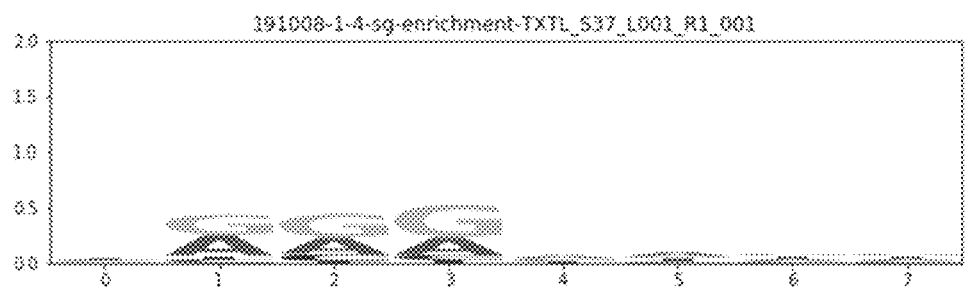
Figure 27:
Figure 27:
Figure 28:
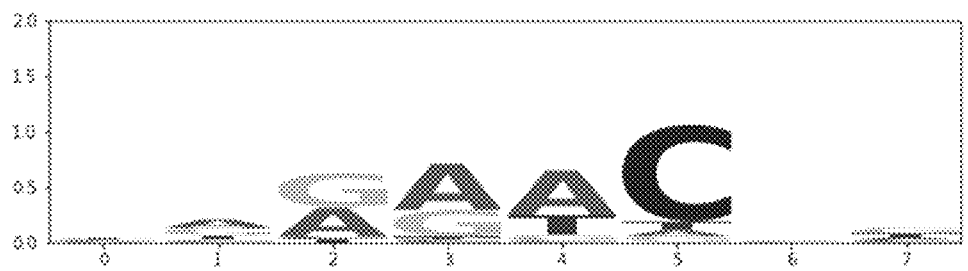
Figure 28:
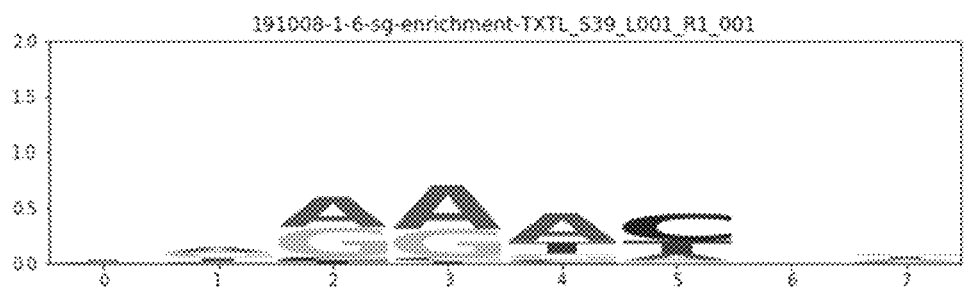
Figure 28:
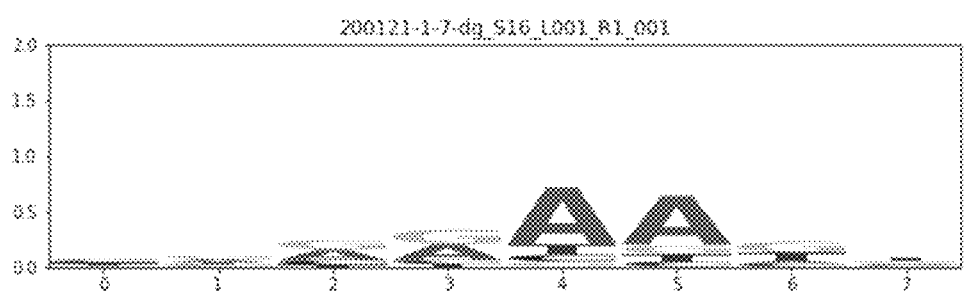
Figure 28:
Figure 29:
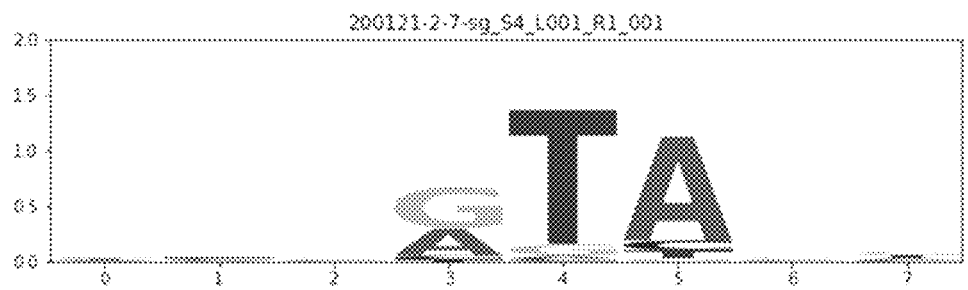
Figure 29:
Figure 29:
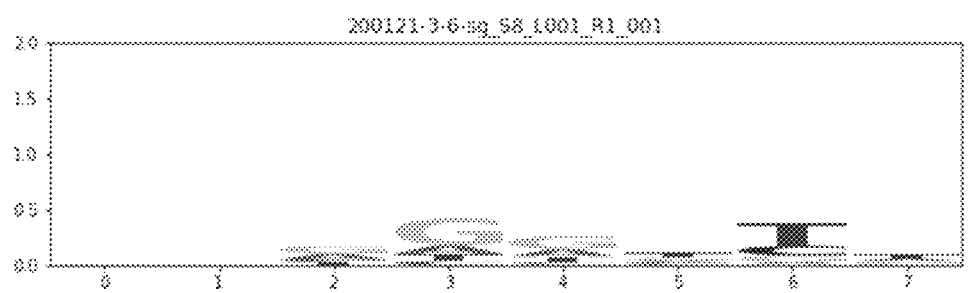
Figure 29:
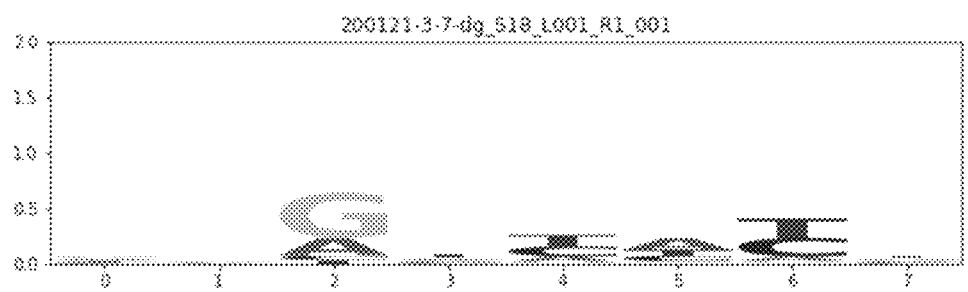
Figure 30:
Figure 30:
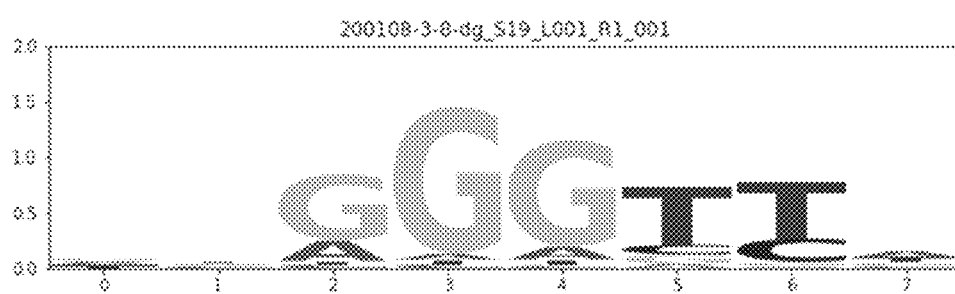
Figure 30:
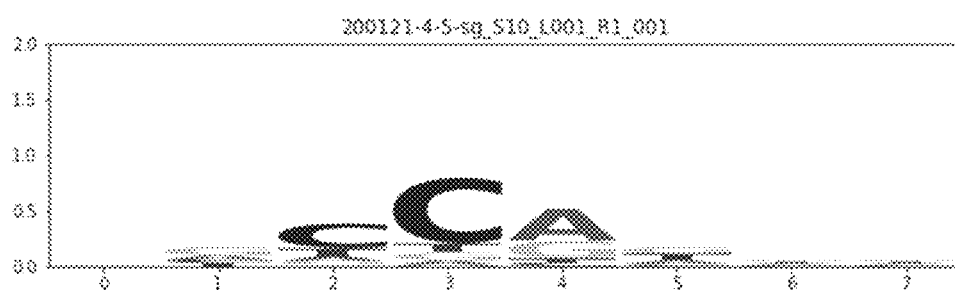
Figure 30:
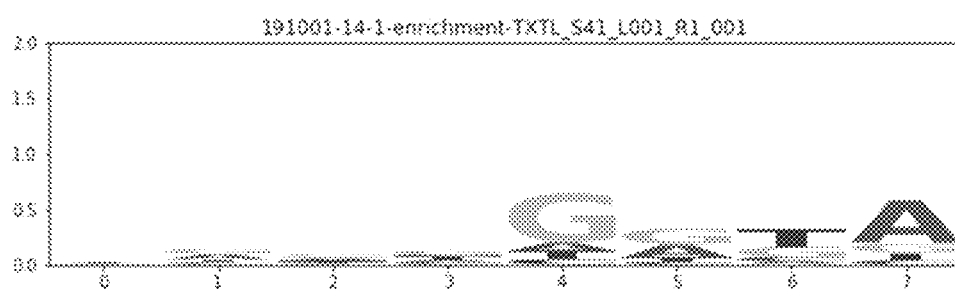
Figure 31:
Figure 31:
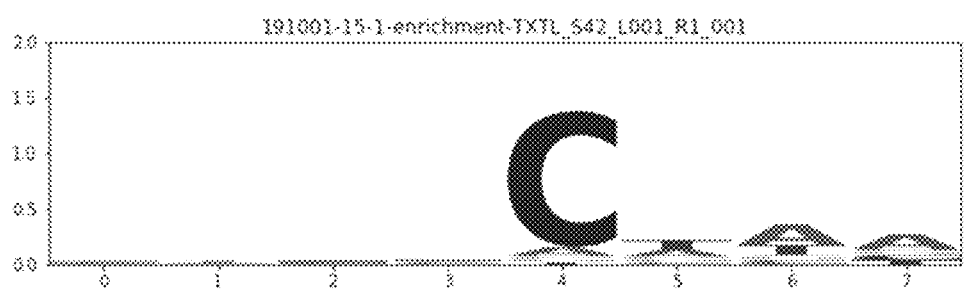
Figure 31:
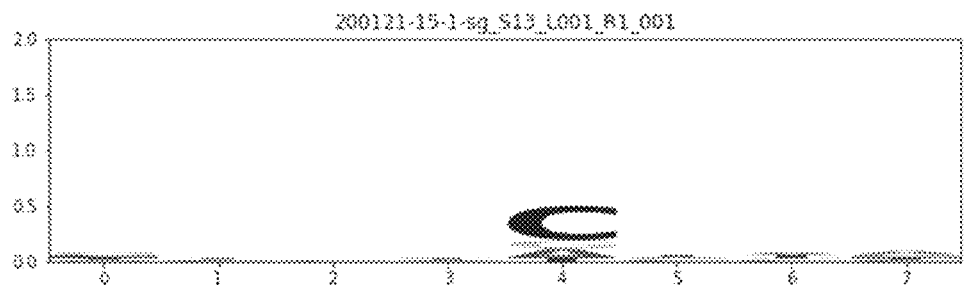
Figure 31:
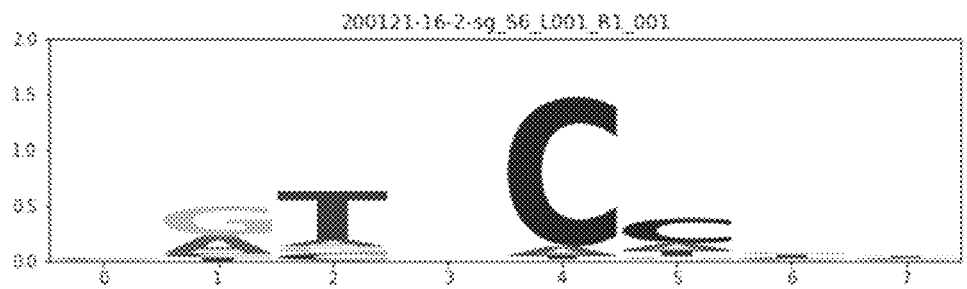
Figure 32:
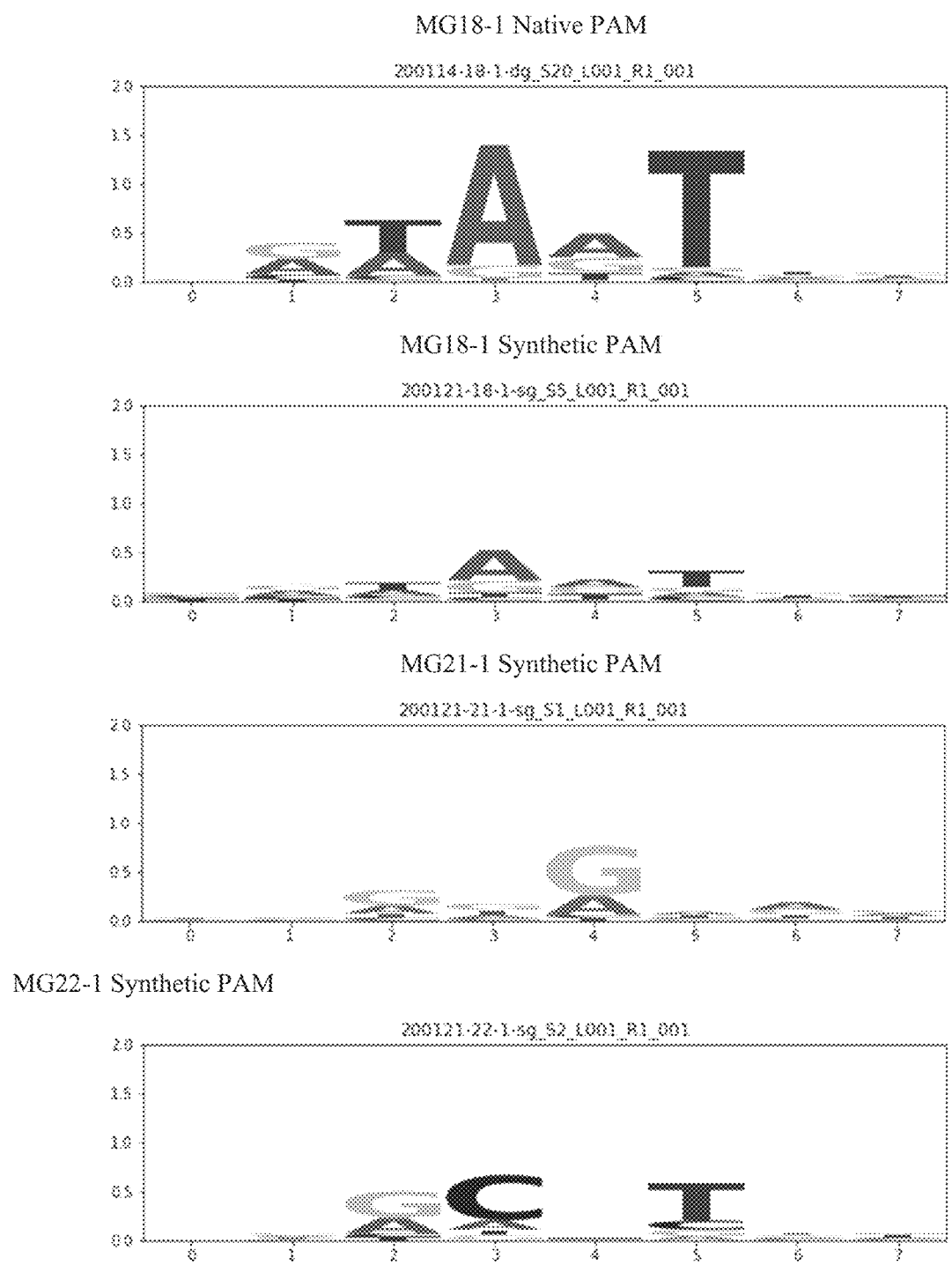
Figure 33:
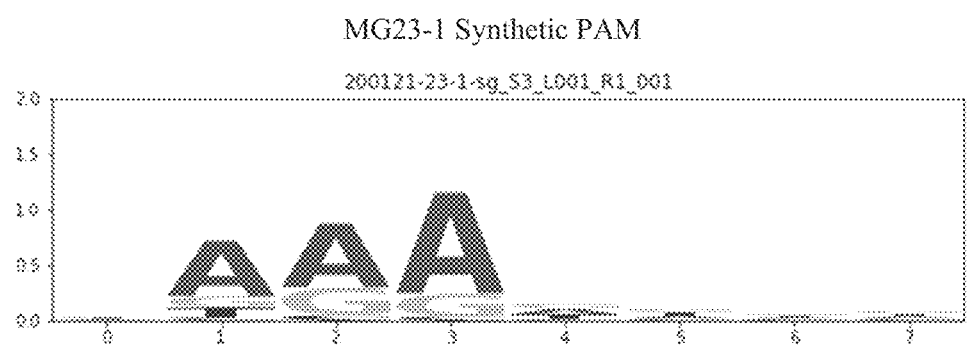
Figure 34:
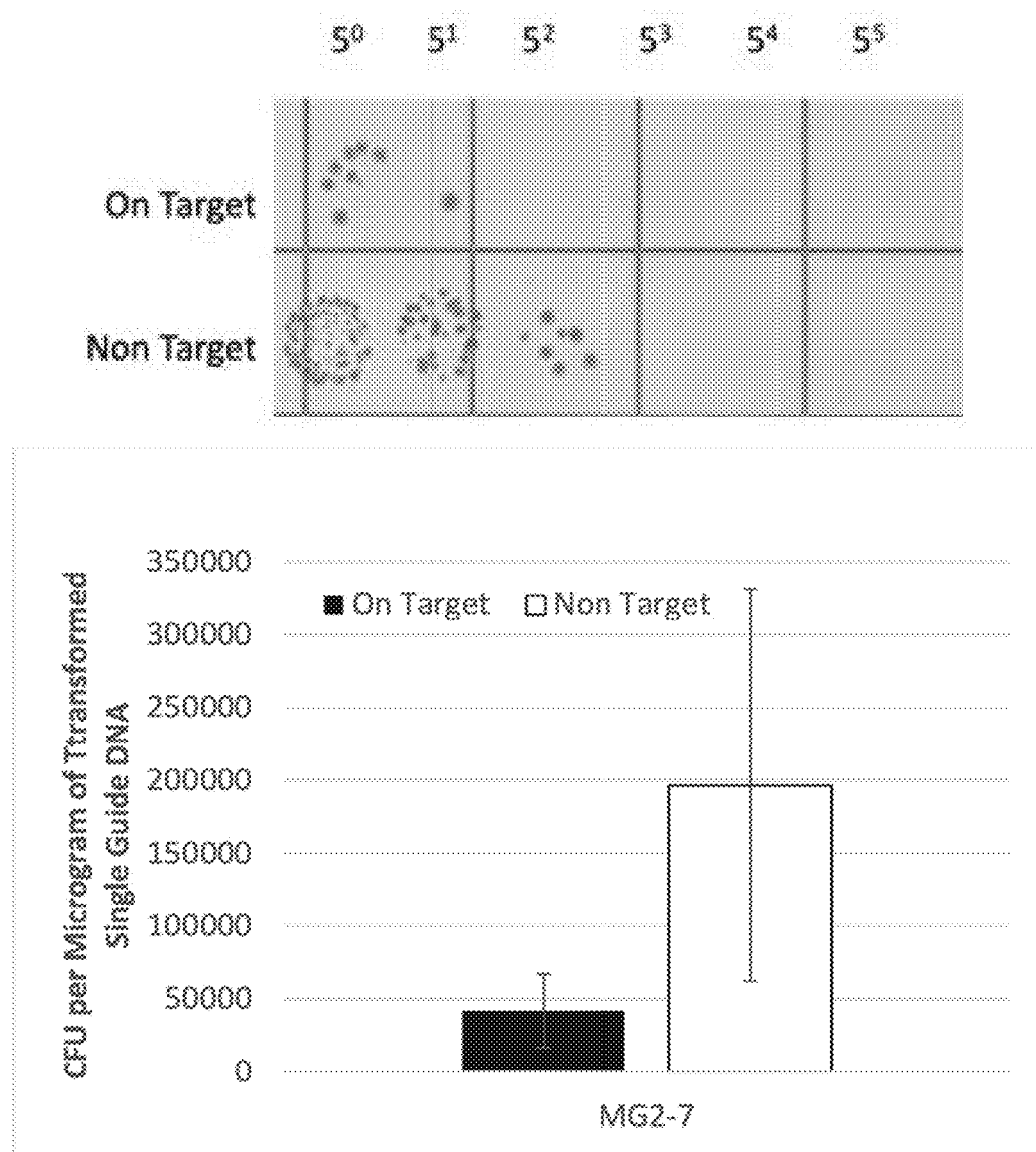
FIG. 34 depicts in cell cleavage of *E. coli* genomic DNA using MG2-7 along with its corresponding sgRNA. Shown are dilution series of cells transformed with MG2-7 along with target or non-target spacer (top); bottom panel shows the data quantitated, where the right bar represents non-target sgRNA and the left bar represents target sgRNA.

In vitro activity of the MG15-1 endonuclease system (protein SEQ ID NO: 930; sgRNA SEQ ID NO:5470) was tested with the PAM sequence GGGTCAAA using the method of Example 8. The single guide sequence reported above (SEQ ID NO: 5470) was used, with varying spacer/targeting sequence lengths from 18-24 nt (replacing the Ns of the sequence). The results are shown in FIG. 16, wherein the top panel shows a gel demonstrating DNA cleavage by MG15-1 in combination with different sgRNAs having different targeting sequence lengths (18-24nt), and the bottom panel shows the same data quantified as a bar graph. The data demonstrated that targeting sequences from 18-24 nucleotides were functional with the MG15-1/sgRNA system.

Targeted Endonuclease Activity in Bacterial Cells

In vivo activity of the MG15-1 endonuclease system with a sgRNA (endonuclease SEQ ID NO: 930; sgRNA SEQ ID NO: 5470) and a GGGTCAAA PAM sequence was confirmed using the method described in Example 9. Transformed E. coli were plated in serial dilution, and the results TABLE 9a Activity of MG14-1 at various target sites

| target ID | target sequence | PAM | locus | % NHEJ (mean ± std) |
|---|---|---|---|---|
| 1 | cttattaataaaattcaaacat | CCTAGGTA | Albumin | 0.22 ± 1.04 |
| 2 | gttggtggtgaggccctgggca | GGTTGGTA | HBB | 0.67 ± 0.16 |
| 3 | ctagttaatggaataaaacatt | TTATGGTA | Fibrinogen | 0.15 |
| 4 | gcattataatgcaccaaggctt | TATAGGTA | Fibrinogen | 0.2 |
| 5 | gtggcggggtcccaggtgctga | CGTAGGTA | FANCF | 5.33 ± 4.13 |
| 6 | tgtccgccgccggccggggagg | AGGTGGTA | VEGFA | 4.88 ± 0.65 |
| 7 | ggtgatgcaccctctgcccgat | GCTTGGTA | Apolipoprotein | -0.35 ± 0.59 |
| 8 | ccacatcaactttcctggcaac | TTGCGGTA | Apolipoprotein | 0.195 ± 0.98 |
| 9 | gctagttaatggaataaaacatt | TTATGGTA | Fibrinogen | 0.6 |
| 10 | gcattataatgcaccaaggctt | TATAGGTA | Fibrinogen | 1.17 ± 1.42 |

Example 15.—Characterization of MG15 Family Members

PAM Specificity, tracrRNA/sgRNA Validation

The targeted endonuclease activity of MG15 family members was confirmed using the myTXTL system as described in Example 6. In this assay, PCR amplification of cleaved target plasmids yields a product that migrates at approximately 170 bp in the gel, as shown in FIGS. 17-20. Amplification products were observed for MG15-1 (dual guide: see gel 7 lane 7, single guide: see gel 3 lane 9) (SEQ ID NO: 930). Sequencing the PCR products revealed active PAM sequence specificities detailed in Table 10 below.

Figure 35:
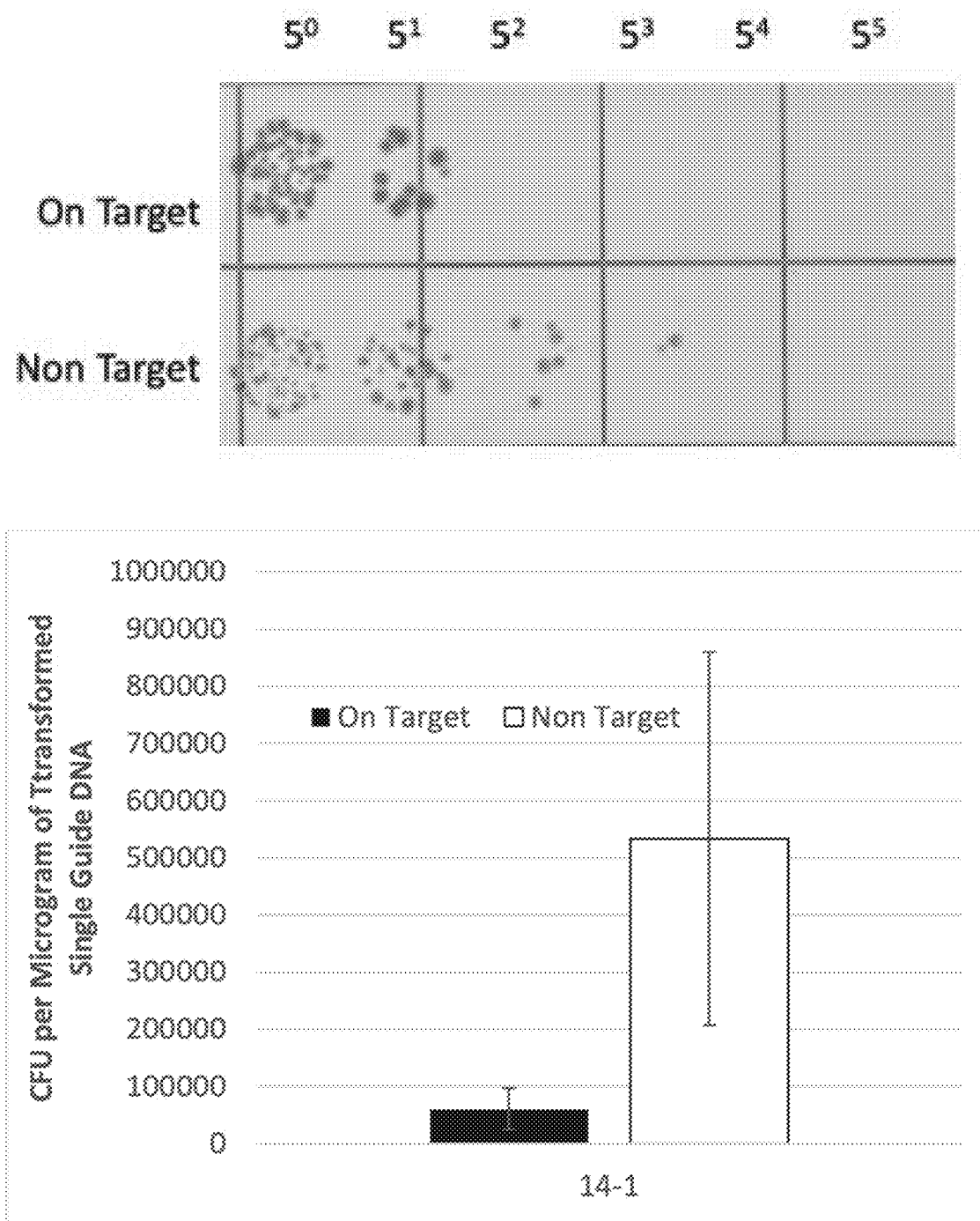
FIG. 35 depicts in cell cleavage of *E. coli* genomic DNA using MG14-1 along with its corresponding sgRNA. Shown are dilution series of cells transformed with MG14-1 along with target or non-target spacer (top); bottom panel shows the data quantitated, where the right bar represents non-target sgRNA and the left bar represents target sgRNA.
Figure 36:
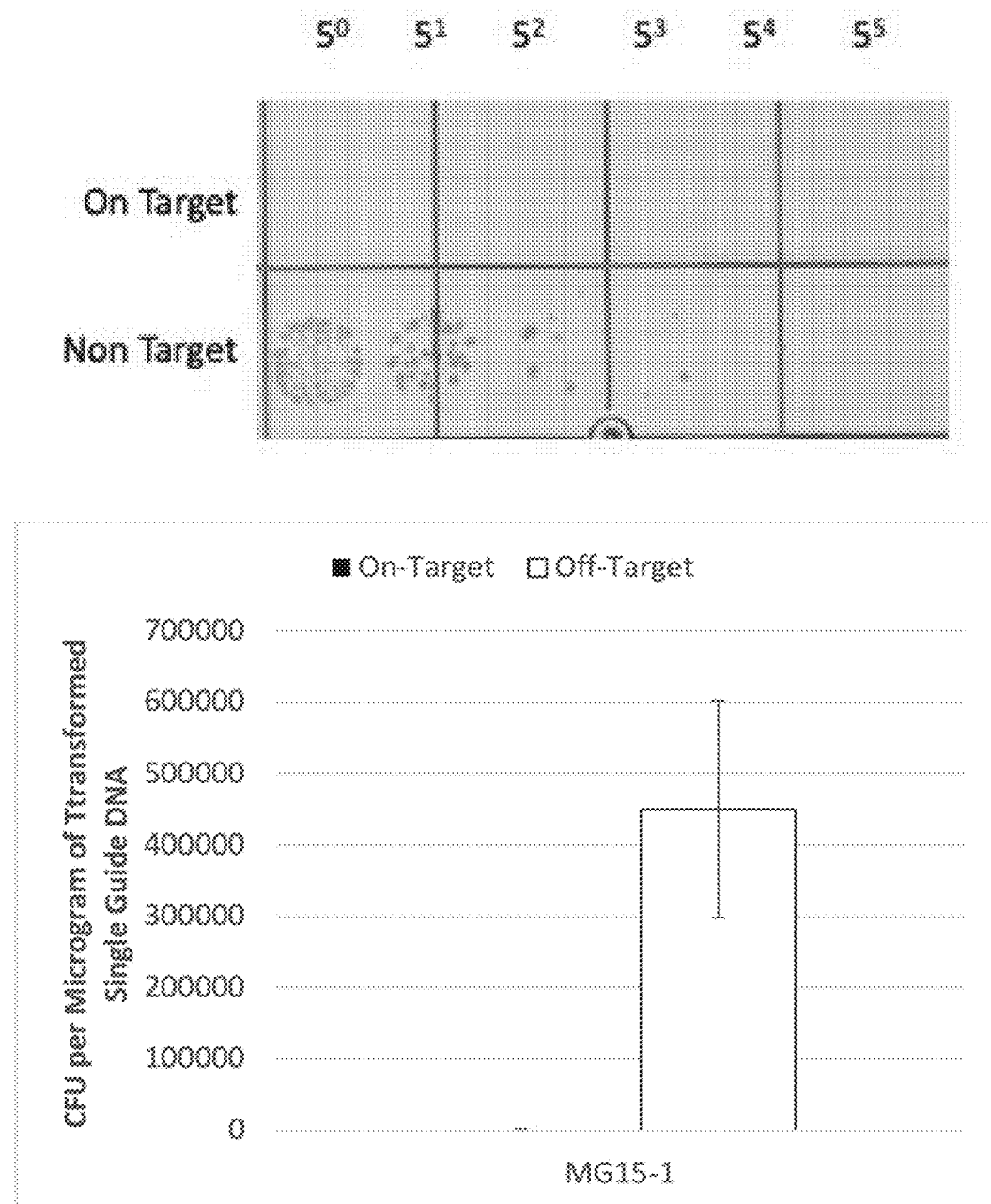
FIG. 36 depicts in cell cleavage of *E. coli* genomic DNA using MG15-1 along with its corresponding sgRNA. Shown are dilution series of cells transformed with MG15-1 along with target or non-target spacer (top); bottom panel shows the data quantitated, where the right bar represents non-target sgRNA and the left bar represents target sgRNA.

(showing E. coli serial dilutions in the left panel and quantitated growth in the right panel) are presented in FIG. 35. A substantial reduction in the growth of E. coli expressing on target sgRNA compared to E. coli expressing non-target sgRNA indicates that genomic DNA was specifically cleaved by the MG1-4 endonuclease in E. coli cells.

Example 16.—Characterization of MG16 Family Members

PAM Specificity, tracrRNA/sgRNA Validation

The targeted endonuclease activity of MG16 family members was confirmed using the myTXTL system as described

TABLE 10

| Enzyme | Enzyme protein SEQ ID NO | Native (dual guide) PAM | PAM SEQ ID NO: | tracrRNA SEQ ID NO: | sgRNA SEQ ID NO: | Synthetic (single guide) PAM | Synthetic (single guide) PAM SEQ ID NO: |
|---|---|---|---|---|---|---|---|
| MG15-1 | 930 | nnnnC | 5536 | 5506 | 5470 | nnnnC | 5521 | in Example 6. In this assay, PCR amplification of cleaved target plasmids yields a product that migrates at approximately 170 bp in the gel, as shown in FIGS. 17-20. Amplification products were observed for MG16-2 (see gel 11, lane 17) (SEQ ID NO: 1093). Sequencing the PCR products revealed active PAM sequence specificities detailed in Table 11 below.

TABLE 11

PAM sequence specificities and related data for MG16 enzymes

| Enzyme | Enzyme protein SEQ ID NO | sgRNA SEQ ID NO: | Synthetic (single guide) PAM | Synthetic (single guide) PAM SEQ ID NO: |
|---|---|---|---|---|
| MG16-2 | 1093 | 5471 | nRTnCC | 5522 |

Example 17.—Characterization of MG18 Family Members

PAM Specificity, tracrRNA/sgRNA Validation

The targeted endonuclease activity of MG18 family members was confirmed using the myTXTL system as described in Example 6. In this assay, PCR amplification of cleaved target plasmids yields a product that migrates at approximately 170 bp in the gel, as shown in FIGS. 17-20. Amplification products were observed for MG18-1 (dual guide: see gel 9 lane 9, single guide: see gel 11 lane 12) (SEQ ID NO: 1354). Sequencing the PCR products revealed active PAM sequence specificities detailed in Table 12 below.

TABLE 12

PAM sequence specificities and related data for MG18 enzymes

| Enzyme | Enzyme protein SEQ ID NO | Native (dual guide) PAM | PAM SEQ ID NO: | tracrRNA SEQ ID NO: | sgRNA SEQ ID NO: | Synthetic (single guide) PAM | Synthetic (single guide) PAM SEQ ID NO: |
|---|---|---|---|---|---|---|---|
| MG18-1 | 1354 | nRWART | 5537 | 5508 | 5472 | nnnRRT | 5523 |

Targeted Endonuclease Activity in Mammalian Cells

Figure 44:
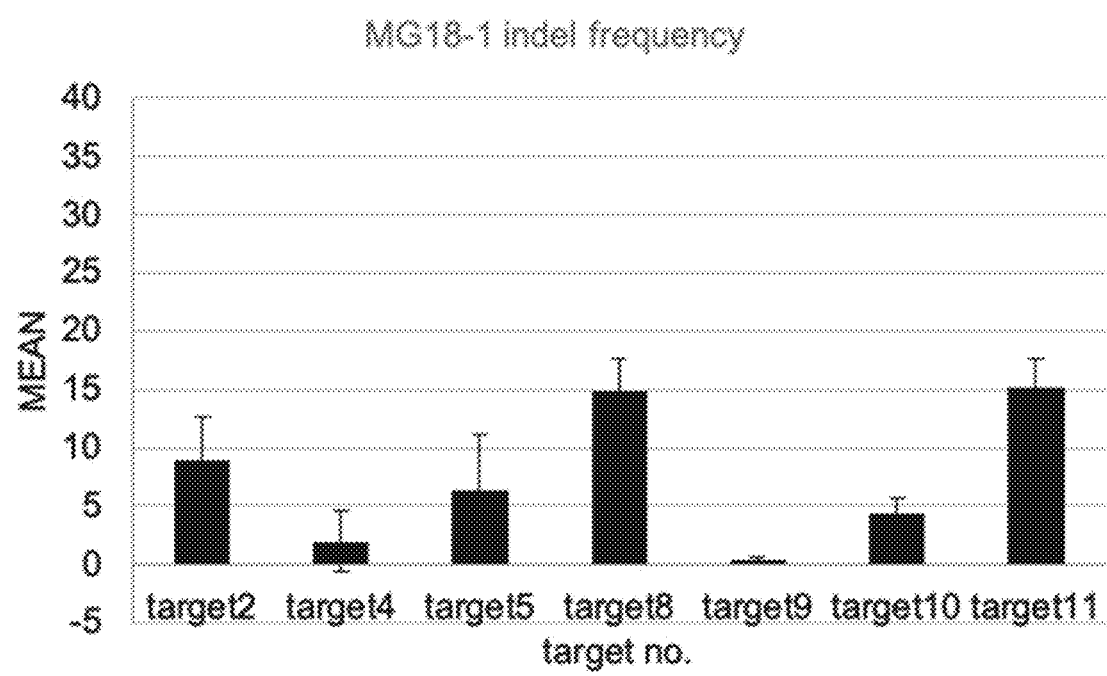
FIG. 44 depicts in cell indel formation generated by transfection of HEK cells with MG18-1 constructs described in Example 17 alongside their corresponding sgRNAs containing various different targeting sequences targeting various locations in the human genome.

MG18-1 target loci were chosen to test locations in the genome with the PAM nRWART (SEQ ID NO: 5537). The spacers corresponding to the chosen target sites were cloned into the sgRNA scaffold in the mammalian vector system backbone 1 described in Example 10b. The sites are in Table 12a below. The activity of MG18-1 at various target sites is shown in Table 12a and FIG. 44.

TABLE 12a

Activity of MG18-1 at various target sites

| target ID | target sequence | PAM | locus | % NHEJ (mean ± std) |
|---|---|---|---|---|
| target2 | tgcttattatggacaagtagca | agaaat | Fibrinogen | 9.003 ± 3.70 |
| target4 | tccctgaagatgctcacagttt | gatagt | IVS40 | 1.99 ± 2.56 |
| target5 | ttttatttctcctgcatatgat | gatagt | IVS40 | 6.303 ± 4.82 |
| target8 | tgtggggcaaggtgaacgtgga | tgaagt | HBB | 14.897 ± 2.73 |
| target9 | atggtgcatctgactcctgagg | agaagt | HBB | 0.387 ± 0.32 |
| target10 | agaacagcccagaagttggacg | aaaagt | VEGFA | 4.3 ± 1.29 |
| target11 | tcctccgaagcgagaacagccc | agaagt | VEGFA | 15.22 ± 2.40 |

Example 18.—Characterization of MG21 Family Members

PAM Specificity, tracrRNA/sgRNA Validation

The targeted endonuclease activity of MG21 family was confirmed using the myTXTL system as described in Example 6. In this assay, PCR amplification of cleaved target plasmids yields a product that migrates at approximately 170 bp in the gel, as shown in FIGS. 17-20. Amplification products were observed for MG21-1 (see gel 11 lane 2) (SEQ ID NO: 1512). Sequencing the PCR products revealed active PAM sequence specificities detailed in Table 13 below.

TABLE 13

| Enzyme | Enzyme protein SEQ ID NO | sgRNA SEQ ID NO: | Synthetic (single guide) PAM | Synthetic (single guide) PAM SEQ ID NO: |
|---|---|---|---|---|
| MG21-1 | 1512 | 5473 | nnRnR | 5524 |

Example 19.—Characterization of MG22 Family Members

PAM Specificity, tracrRNA/sgRNA Validation

The targeted endonuclease activity of MG22 family members was confirmed using the myTXTL system as described in Example 6. In this assay, PCR amplification of cleaved target plasmids yields a product that migrates at approximately 170 bp in the gel, as shown in FIGS. 17-20. In the assay shown FIGS. 17-20, active proteins that successfully cleave the library result in a band around 170 bp in the gel. Amplification products were observed for MG22-1 (see gel 11 lane 3) (protein SEQ ID NO: 1656). Sequencing the PCR products revealed active PAM sequence specificities detailed in Table 14 below.

TABLE 14

| Enzyme | Enzyme protein SEQ ID NO | Native (dual guide) PAM determined | PAM SEQ ID NO: | tracrRNA SEQ ID NO: | sgRNA SEQ ID NO: | Synthetic (single guide) PAM determined | Synthetic (single guide) PAM SEQ ID NO: |
|---|---|---|---|---|---|---|---|
| MG22-1 | 1656 | N/A | N/A | 5510 | 5474 | nnRCnT | 5525 |

Example 20.—Characterization of MG23 Family Members

PAM Specificity, tracrRNA/sgRNA Validation

The targeted endonuclease activity of MG23 family members was confirmed using the myTXTL system as described in Example 6. In this assay, PCR amplification of cleaved target plasmids yields a product that migrates at approximately 170 bp in the gel, as shown in FIGS. 17-20. Amplification products were observed for MG23-1 (see gel 11 lane 4) (SEQ ID NO: 1756). Sequencing the PCR products revealed active PAM sequences specificities for these enzymes detailed Table 15 below.

TABLE 15

| Enzyme | Enzyme protein SEQ ID NO | tracrRNA SEQ ID NO: | sgRNA SEQ ID NO: | Synthetic (single guide) PAM | Synthetic (single guide) PAM SEQ ID NO: |
|---|---|---|---|---|---|
| MG23-1 | 1756 | 5511 | 5475 | nRRA | 5526 |

Systems of the present disclosure may be used for various applications, such as, for example, nucleic acid editing (e.g., gene editing), binding to a nucleic acid molecule (e.g., sequence-specific binding). Such systems may be used, for example, for addressing (e.g., removing or replacing) a genetically inherited mutation that may cause a disease in a subject, inactivating a gene in order to ascertain its function in a cell, as a diagnostic tool to detect disease-causing genetic elements (e.g. via cleavage of reverse-transcribed viral RNA or an amplified DNA sequence encoding a disease-causing mutation), as deactivated enzymes in combination with a probe to target and detect a specific nucleotide sequence (e.g. sequence encoding antibiotic resistance int bacteria), to render viruses inactive or incapable of infecting host cells by targeting viral genomes, to add genes or amend metabolic pathways to engineer organisms to produce valuable small molecules, macromolecules, or secondary metabolites, to establish a gene drive element for evolutionary selection, to detect cell perturbations by foreign small molecules and nucleotides as a biosensor.

While preferred embodiments of the present invention have been shown and described herein, it will be obvious to those skilled in the art that such embodiments are provided by way of example only. It is not intended that the invention be limited by the specific examples provided within the specification. While the invention has been described with reference to the aforementioned specification, the descriptions and illustrations of the embodiments herein are not meant to be construed in a limiting sense. Numerous variations, changes, and substitutions will now occur to those skilled in the art without departing from the invention. Furthermore, it shall be understood that all aspects of the invention are not limited to the specific depictions, configurations or relative proportions set forth herein which depend upon a variety of conditions and variables. It should be understood that various alternatives to the embodiments of the invention described herein may be employed in practicing the invention. It is therefore contemplated that the invention shall also cover any such alternatives, modifications, variations or equivalents. It is intended that the following claims define the scope of the invention and that methods and structures within the scope of these claims and their equivalents be covered thereby.

SEQUENCE LISTING (5718 sequences)

SEQ ID NO: 1 - protein, 1025 aa, Unknown
  Description of Unknown: uncultivated organism with predicted taxonomy: Candidatus Melainabacteria
  MG1-4 effector
MKKKVFAFDLGKASIGYCVRDGFNINEANSIIIDKDHAETMSLRDRRRIKKTLDAHHAREEYFNKVWSGVGLNILDKNNNNFKKEFPSKNEDVIYTSCLLRIALLQNQKLEEWQIYKALYNAFQRRGYDVNIAWKSVQTDDDKENIERMKKYTCENDIELIISDEYKYPCYYDALRLGLWNEDEPTKLNRSIPQHNSNKVRTTEYVAPRELVEKELKQLWLNAQLQLPQLNSISAEEFLYGEYKIPYGSCVQKEFKQYRGTKKDWQGVLCQKIPRFDNRIIAKCKLLPKRNVCKANTIENVSFVLLMKLKNLRFTVISGEKLRLSPVQIKQIYENWLEKVEDTYNKDLEKAEKLGKENPEKRLNITITRQEIEKIIGEKIIDKIEPMKADISGRSSFCRRACQIMNKIILDGELYPQNVDISEFVDRDNAKNGITEEEIQSMLSKIGDWNNLYIPDNREENAQNASNSRIKTDIMLGNITNPIVRNRLQIFRDLLLNLAEKYGTPDEVIFEFVRDGADNSLYGSKKAQDTERFMKQQEKENEQIINELKDAGLYVNGQNHANATYFLMHKLLKSQGGKCIYSGQNISPSNYDECEIDHIYPRTLGGNDALYNKVVCYRRENQDKKGRTPYEWLSPDSDKWANYVNRLNKIKKQLGKKKFELLTSKPEDCEKLIESYNGLAETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDKPFKGNTKPLETIYGLRTYGDKSYITQRVELNSIDKKATKIKSIIDETIKNDLLNKLKENPTEQEWKLMLQNYIHPKKQTKVKKVMISVSEGEITKDSNNRERMGEFVDFGTKGTQHQFKHSKRHKGQILYFNEKGVVEVMPVYSNIKTTDVKDKLQNMGCKLYNKGQMFYSGCLVDIPKPFKAGSKEYPAGRYQIKTIRSDKVAELEDACGNKISTNVKYLVPAEFKKVESK

SEQ ID NO: 2 - protein, 1077 aa, Unknown
  Description of Unknown: uncultivated organism with predicted taxonomy: Verrucomicrobia
  MG1-5 effector
MHTKETVWGFDIGKGSLGEAVRVGNEFKHVLSMEIDADFAEIKTAAATRRAWRTREAHKAREMWLEKCLSDADIEILGRRKVDIVDGTWKLVSRGDGRLEREFPADGENVCYNSIALRCKLLLGEKLESWQVFKALNSAIQNRGYDAQIPWGDEDGKSSETKRSGKSDSAKKSGEDESYAERLALFEREFDKLLAEVENREKYDFPCFFKAAKMGLWSPENPDKVGIRIDNTAEKAKGYVVPRNAVIAEFRALVNAAAKQYPKLKGKADFIMFGKAEEAYASYKPELRRKFGLRRGADSDWTALGQKTPRFDNRIIGKCKLIPRLNVCKIKPLKECKAEDDFLPHTITLALKLLNLRFFRGAGIDSLSFDEFLRAFEIARQNKFALNKTNLKKFFKTIGAEIMDENQSSVEQPREGGRASYSRPAMRLLRDLIFSGKSPAEFYASRICKIENTDKNRGLVAEDLAFIKLMGDIPWNGIFVPDVDTFNFANIRESERADKINKLIGSQNDPIVRHRLAFFYERIKLLESKFGAPDKIVLEFVRDDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGDKTPFEWLSSDKTKWESYCDRVRSLTQSLGAKRCKLLVSPNAEELMQKYTALAETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLAEVVPTKVAIKKPELEQTIYSKRVIGGRQTIVKKCNVRDLAYKGQNPKYDFDTLTKRIKDIINPVSKRVIEDFAKTEPTEAEWEDWCKYEAAIPSKNGSPTRLLRVLCKTKDDAERFKDLSKDGCGAYRKSKSHKGQFIWKDNKGNYLVAPVYIYSSKQKVYAELKNNPKCMGICDFFKTGCLVKISNEVVDEKKNRLWLKAGFYNLNSIAKEKRVYLTDVNGQEHKKIPLQHLMNAGMKRVETNTI

SEQ ID NO: 3 - protein, 1059 aa, Unknown
  Description of Unknown: uncultivated organism with predicted taxonomy: unclassified Verrucomicrobia (miscellaneous)
  MG1-6 effector
MEKEKNNHVWGFDIGKGSLGEAVRVGGDFKHIASVLLDPEFGEIKTAALARRQMRTRKAHKAREKWLEECLDGTGVEILKRREVGIVDGQWRLISKGDERLEREFPPNGEEVCYNSIALRCKLLLGEKLEGWQVFKALNSAIQKRGYDENIPWGEAEEKSSKKDEDDYAQKLSQYEREKSELFESFADGEKYDFPCFFKAYKMGLWSPENPRRVEVRIDCRAQKAKSYVVARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIASGAKYKMTKTAMKKFLKSISATALGDDYAEIEPPKESGRASFSRPAMDILKELIFSGMPPREFYGRKIPEISNTDKNKGVVASDLDFIKLMGDCPWGGIFIPDVQTYQFANAAFPNPDAQINKLIGSQNNPIVRHRLTFFFERIKFLESKYGVPDKVVLEFVRDDFMGEKEKKEMRIAMKKRAEEKMMIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNAAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVLRVLVYYGEADEYKDLSKDGCGAYRKGDGHKGQVVWESVDGKYYVEPVYVHASKAGVMAALNANPKKKRICGMFNSHCTVDVGDVYNDRGDFILPAGRYMVNTILTTGRCVLTNADGEKRNPININYLMRAGMRRVELSEL

SEQ ID NO: 4 - protein, 1061 aa, Unknown
  Description of Unknown: uncultivated organism with predicted taxonomy: unclassified Verrucomicrobia (miscellaneous)
  MG1-7 effector
MKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 5 - protein, 1294 aa, Unknown
  Description of Unknown: uncultivated organism
  MG1-1 effector
MWAFDLGKGSIGEAVRQGNDFKHKESLLIPHELARRGPAAVSGTPANKYRAKKTREAHLERERWLDTIWKVAGLTPLQARAVWENPETQKWELKHKGDYRLEREFAPKQFKKGAGGELVPIKYPNGKATDGAPAEKKADFETCYTSALLRIRLLQGDPSLKDWQIFKALRAALQSRGYGPVPWATKEARKQGRTPEELAREEEKKLQSADPRYREAVNKWQAFKDSVPKAFHFPCYFDAWKLGLWLHAKPDELGCRINHLAESTRNIRFDRADVRVELIRLGDQAAEILPALKKAFSDWQSGGWKYQHPVTGEKLTYPLRAKTFGEFLCDGPAGTPDESSFEAFLDQRHKAGLNRGSFEEWMAALGQKTPSFDNRILNNCVLIPRFHVCKMDVRLVMDEQGKLTGQIVTESLLATEVTLLLKLKNILVADPSAKDGQRKLTVGEVQDILAYAHRRLAELELVAADGTLLNLWPSKVAQRFSISKSSWRDVAVEAEFLRRMTASNIVVGSETRRLTIAEASSLLRAIANPKKGLEAQLPKDLQLLTKTAKSEFKKAKTASDEKTLRPMPGHEEVKAPKSSGRCGYSRVALRILKELILSGQAPSAFHSRLRELDTELLRKLGSSPEKPLVLIDDSKSQDQEQRKKENIENGKRGLLVSELNFLRQMRKERATEDSWENFFIPSQTIDALQQRHTQDGKLDSQSAIRELLGTINDPIVRHRLGVLAERLRKLQCGDEKRDSPGFGVPDAIVLEFVREDFMGEEAKREYQNFINEREKDRKAAREEAGKLGFDSRSSGLRYELWKAQGCCCLYTGRALAETELDQYEIDHIVPRSLGGPDAIVNYALTFHDINHTKEKGKLTPFTLLHGKPGWAEYLLRVDARATFLRNKKVQLLTRPDAAELVQRYTALAETAWISKLAQAIVNLQFGWTNGYDEKRERRVIVVSGGLTARVRRKYGLDKLLYNDVTDLEVLAKKVKNRDDKRHHALDAMVMTFIPQWARNPDQEGFFRFPREFRDASGREDYQKVRQLFAKHLSEVMPTNIAFERAALADTSFGLRVEGGKRIIVKRVSLFDLAQEPAGAPGKTKFSSKYLLKKIEWVRDATIRRRVKEEFLHKEPTEPNWQKFCDSFRQNSRNGVPGARIMKVWVYAGEPNEFKDLSKDGEGAMRKAKDDHQGQIIYTANDGELAVNPVYAHASITREMKRLRESGSKAKVHCFVRSKCIFHLRKAVPQPEYKLVVKNEQKQKRRIPATLALAPAKFMLNTIITDSMDVEFSAANGQRLVAPLRVLIDAGFEPV

SEQ ID NO: 6 - protein, 1031 aa, Unknown
  Description of Unknown: uncultivated organism with predicted taxonomy: Verrucomicrobia
  MG1-2 effector
MTWAFDLGLGSIGEAVQQKGEFKHAASWLVPSEFASTKAARTRRRMWRTRQAHKARESWLNQCLRSAGMEVLVGRRVERGPQGWTTLPGDPRLEREFPSAGDTTCYNSALLRIRLLRGETLAPWQVYKALHAAIQRRGYDPNIPWKSGASRSTEEKEEGETRARAAEYQSLLEDMAPGRTEFHYPCYLQAWKMRLWNPGQPEVLQERVSHDAESIHGMVAPRTLVEKEVRDLVAAAARYHPQLAGQADFILWGPACKPYASHNGTLRKQHGLRQGSEEDWEGVMGQKIPRFDNRIIEKCALIPRFNVCKMAPEGRAAAQPDAALPREVAFLMKLKNLRFSRGGGIAHLEAAEIATLFEKRREALSLTQKQWETACEKLGGRPLPPDLEVKAPRLGGRSAFCRPALKHVKELILSGKSPRDFHAEALARLHGNTNPQKGLVPADLDFLLRMGDSWEGLYLPNKRLEAISSRARTPDEAIREVIGSVNDPIVRHRLQLFVERLDELETRFGPPDQVALEFVREDFMGEKAKIEYRKFLNRREKERKEAREQAGQLGATSGSSGLKMELFKAQRGQCLYSGQRLHETKIEDYVIEHIVPRAKRGPDAVINYVLTTEELNNDKSDHIPFEWPYLKKQWDAYTQRVESCAGALGVKRVRLLVSPDAVELAQKYTALAETAWISKLAQTILNLKFGWTNGNTPDGRKAVVVVPGGLTARIRRKYSLNSLLAGDGVDEEEAEKKNRKDHRHHALDAMVISFLPGWVANPDKEHFFRFPEPVRANPRGFFQTAIHNVVPRQLCFEKGKLEETIYARRTIAGNSVAAVRQEFRALAFKSVGINKTEFNLDYLYKQTDKILEPRIRQLVQDFASTEPNEAAWERFCDEVRLPRKDGHPGPHVRRVRMRVGPMDEFKNLSKDRAASGAYRKGSTHHGQWVYRDATGRSLVRPVYAFESAGQVRRELIAMHGLDALVGYFQSGCLVELVRPVAHKKTPLAPGQFSLNTLRKDGFAVVTDARGRKSEPISLKTLLESGFHRVTS

SEQ ID NO: 7 - protein, 1200 aa, Unknown
  Description of Unknown: uncultivated organism
  MG1-3 effector
MNEYILREPDRKPLAEEWLNHEFYRSAVVLGIDIGLEGIGVYLRRGPQEIFARSIMLELPEAEALAERRQKRAWRHCRKNRKRRLHRLKQLFAKHGLPWLDADRMSRAHPFRERYRAINNGVASKEALSICIRHCVVHRGYDYGGTEEGTFPWGESPLLSKAAEWLATAYVTPELKEQIEQRAPGLVPGKNEEEQRNKFAELLRERLEWSQQHDIARVLAEHVKGGHDNLRTRARGYNFPRQKVWEHLETIVRKHAHLIDDVEGFLAVLGLNPNKAANAKEAAKARKRAIFFYNRKTRFDMERHWEKKVNRCPFAGKLGGNPDERCAENGDLNVRRWKALEFAATRRVEIEATEGKGATKKKRRCLHSLSASATRKLIEFIEKHHGAASPATAPKWEEGKAIILDDITAVHGEKAKPVAEKQSEWNKSYFTQLKDLLTPTLANRKKRASLSAFAAGHLFNIATADSSDFAPENVVTRLREAGFYDWRRNASVDFNPFPQVELLLGRRIKHGKRRGELSPTCQGLLRRIFAEHREALGGATAPDYCVIEVIGDPPRNARQRAERQKEIEANREKREKLFEQYGIEDSGVASKRRRIMLYEQQRGKCPYTGRDLPSNPLDPSLEIEHIFPVEMGGLSVDDNLVLTWRSVNAEKGKRTPLQWAGERFDAMLANTRDMRWSARKREIFAWGTIREDKPDKPSHYNADGTLRVPDFGNTTRTAQLARQLRAEIMRWMQVDDKPDEAARRIGTPSGWLAAQARKSWLPAEEYEKVRNNVTHHLIDAAILAHIPPREGMNSVRCKGIFYVESVPVRDPVTGDTTYRLETKALPELSPLPRLKHWLPDNGEYDVCPVWKPRRQSKTQSLGDSTFWRQVRPDEATVAQRTALKPEEITDADELLTTLQRMNIPAKLIPSRSALADWLAAATAATKADKDKPIAPLKLTDGTPVKNLWKFDSKGSFSSPVGWSGKRNPDGKLRELRTISLKYDRLELWLGYDHQKAERARRAKQPDWEQAGWVYQKRLIPDARALRHVKQMGFSFARDKRHKAPAFMQNKPDKPETHQTLRDLVLGGRLLPFSHKVGEIRKGDVFKLHLLPDGSIRKRTPVGQPEPAAALSTFYVVTALKHGRGNPVVKLTSQLFKDKEGTPMERFAGDVLSKILSTADDLAYVLGLPPAAEEAQKHGWRIPTSPPPPAAAAKETDGNLL

SEQ ID NO: 8 - protein, 1200 aa, Unknown; identical to SEQ ID NO: 7
  Description of Unknown: uncultivated organism
  MG1-13 effector

SEQ ID NO: 9 - protein, 692 aa, Unknown
  Description of Unknown: uncultivated organism
  MG1-3 effector
MGYGVKEKMKHFHYSIPRTQEKLHYPNKYKVTKAQWKKWCEEKGYKINLGTSEIPAPKISGRTGFSRPTMLLLREFILSGLGAQDFREKILTTNFKGFEKFKLQEEDLDFLKNIKNNDPQNIYLPNNSLKEKFLNKNTGDMEEAVQKLIGSTRHSVVRHRLTIFFKELQKLEKKFGAPDQIVIEFAREDFSTKDSKKKYENDSKENNRIFEAAKKELQEKFGIDYRRQNENLVRKYMMWEKQGYTCPYTGQALSFEKLPEYEIEHIIPRGNKWNGPDDIKNTVLTTGTENRKKGDNMPFEYIKNEEWEAFKERVNNMKISGKTKNILFARTKEEAEKLIDRYYGLATTGWVARMARDIACLWFGWQPNAEGEKRKLHTVSGSLVGKVRRKFGLNKALNPFLSEADAGKDEKNRDDKRHHALDAMVMTYLDEYMRNPRNFSKLQKELGEMFGKLGGAQYFEERLAEVTPYKIARNKAKLGETAYRKIEVQEKIIKRGKPEIKKEEIIVTRKNIEDAKPKEIIDKNIAKKIDDFLNKKPSEEEKKEFYKKLGIKKITVKKGKPDNLKNLSKNPNARGQYYESKSITGTGTLQHGVYLYSRDGENWKVEPVYAFKSPYKTKKELLEQGFQIKDNALFYAGCIIEVTENIEGKDIDRGKYTAMTIKTAGTIKLRNYKGDIIQTSLPQLKNNFHFIK

SEQ ID NO: 10 - protein, 692 aa, Unknown; identical to SEQ ID NO: 9
  Description of Unknown: uncultivated organism
  MG1-3 effector

SEQ ID NO: 11 - protein, 1271 aa, Unknown
  Description of Unknown: uncultivated organism
  MG1-8 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVKQARAQGKTPEELEAEEQKQLEQADPRYREAAGKWPEFKRAVPAEFHFPCYYDAFHMGLWSPDQPDQLRLRLDHRAASTRNVRFDRANVRKELIALGNNAAAMLPQLQQAFERWQRDGWTFRHPVTGKALTKPVHARTFGEFLCDGPAGQPDETSFEAFLNQRREAGIRIGTFEEWMAALGQKTPRFDNRILAPCVLIPRYHACKVYARLEKDRAGRLTGKLVPDSLLASEVTFLLKLKNLLVADPVKGQRKLTVEEVRDIFAFAQRRLKTLPLFTPEGEPAKEWPSKVANCFAINPSDWPKIAVETECLKGLARLTVSDNGAPRPLTREEAEALLHAVAGGRRAAQSALPAHLLPLVKRAAAAWKQAKQQAGEIMLRPLPGHEEVKAPRTSGRSAYSRVALRILKELILSGDAPSAFHARLVRRDPDLLQRLGPAPGQPLAIFDDSTASNEAQRKQHDAENRKRGLLVSELNFLLQMRKDDGSPDSWENLFIPAQTLEALQQRHTEDGRLDADAAVRELLGTIKDPLVRHRLGVFDERLRKLRFGDARKGLRGFGVPEAIVLEFVREDFMGEQAKRELQTFQKRREQARAEAEAEAAKLGLESRSSALRYELFKAQGGICLYTGRPLSETQLDQYEIDHIVPRSLGGPDAMVNYVLTFPEVNSAKEKGKLTPYALLHGTDGWDAYVARVKARAAALRNKKVQLLTREDAPELVERYTALAETAWISKLAQTIVNLRFGWRNGVDYSGPQPVKRVIVVSGGLTARVRAKYGLDKLLYGENTPPEVLAKKVKNRDDDRHHALDAMVMTFIPHWARDPNKQGFFRFPPAFRDANGREDYQQIQSLFARQLEKIVPRHLAYEPCALADTIYGRRLDKGEPVIVQRVPVRELAYKQEQQRPVFNLTYAKDQIAHLRDPRLRRVLEALVATGPDQVAWDNYCRALAAGTCPELPGRKVLKVTLNRDEDPAEFKDLSKDGCGAFRTRKGEHRGQFVYLDARGRVRVRPVRPFESLVAVKAEVERLAAGGRLIGFFQSMCPVELDQPVTHGNFVLRPGTYRLNTIKKDGRAQVTTAAGEKTPQINLAKLVAAGFRRIA

SEQ ID NO: 12 - protein, 1655 aa, Unknown
  Description of Unknown: uncultivated organism with predicted taxonomy: Verrucomicrobia
  MG1-9 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVNQARAQGKTPEELEAEEQKQLEQADPRYREAAGKWPEFKRAVPAEFHFPCYYDAFHMGLWSPDQPDQLRLRPDHRAASTRNVRFDRADVRKELIALGNNAAAMLPQLQQAFARWQRDGWTFRHPVTREALTKPVRARTFGEFLCDGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAALAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSDLLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAHLGRRKVDLLLRPDAAELAGEKYTALAESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRTKEDFFRFPTAIGDNDFYSKEDQPEMAAIKSQLAKLYVENKPVFREIKQARLAGDFGRLQQLKASVFPARKRIAELYRALDKLKQPRNVRAVREWFRAQLEGASPAPNGPVLPRTMAWQRTPTEATLYRRVYLIYKDCPERSLLALTDLAFAPNPRNPQQPVFDLKWLRTRIQSIAEHPGYDRKKLQSVLSAKLEATLSAKRFASCQFGPEDWQQICAQPEVAACFQPVGRGKSKRPPEPDQRLVKVCKVEVLPATRYELSELGYTSGNNYAWNPDHLAETARNILRKDDAQARTRGRRRTPAPASSPSADASPWPGFLWDREMQAKLASPKFREALEQQLVPHLLPPKPARMSDAERTDWATREERWKQAFEQFRKSHNLPKSFFVFTSDSDRPPRRPNVSLLRVLFEPKDKVFSRDALAKQAQSVVDAQLRRCLECFADSLTQVRDPRLQEKAWRDYCNVVRVVPKETLEQFTREHPTPTADQWISFFEAQTGPRIFQVMQTVGTSLEEYFDLSKDACGAFARGGNKGYWLCKRGDAIEARPIRFFENPEQVRVRLLGQGWELLDPKPWRTGDLLNLPEAAQSGARSVPAGYYFLGSFSNDTGVNLKPCFGGEVPQNVSLKALWNRGLRRCSPTA

SEQ ID NO: 13 - protein, 1147 aa, Unknown
  Description of Unknown: uncultivated organism
  MG1-10 effector
MTHYYQFNSIPDAVSPNSESLEQLKSASARYWAEHDFFSSDTVVLGLDIGMEGIGICVRKGKDILYCKSLLVDLPESEALAKRRAFRASRHVRKNRRRRMRLLKDLFGQYGLPWVDDSIMSRSDPYILRHRAVSKKLASKEALSICIRSLVARRGYDYDAMKEQGNNPWGDSNSVKEVMSWLKTTFVDEKMVQFIKEREEELTEGKGAPLKEETREKLWELLQARKAASDKQDINAMTAAYAKQRISERQAKGMNYPRSMVRKNLEEIIDRHAHLIDDVEGFKASLFRPCVTKEDKGKAIFYYQRKTAEENRLHFEKKVKDCPLAGWLQLGDENSKCCLKGNAWFRLWKLVDFLSVRRFYLKKKEKGSVPIRRLLPASVIESLVKASVHQDDHHFVSGWKDVKAVLNESLACEGWMAIDKGGDVKDQKDWNKEQLIALQDLCSPSASSRQARASLGEASARKLYYMVTQNESNFDPECMEEQKKNCGLYEQRQAISLFGGTFPQVAALLGTIGPDKKNKNGRFVQKTTGILQRIFADLSPMIGGKKVPDYVVVECIRQAPRTETQKKEIEVEQKNNRASKDKMASEFGVGEGKLGRSKYFRIALWKQQGGSKTTKAICPFTGKTLDVDDPLSPQLELAHLYPDTKGGLYMMDNLVLTTREVNKAMDNMTPVEAARAGIFGISCDEMIRRSEQFAWGESKRKLFRFEPTAEESFPDFNNMTRISQLASQLRKQVAFWLGIHADSDDLSAAVALRERIGNPQGQYTAAMRRSLLPESGKDRSGYVHHREDAALLSCMPPMGLNSIKYKGIFYTKMVPWLDSSGQLQQRRSLFALSCADGLPLPDIASILEDDTECPIIKRRSESKYKALGDSTFWHVDEEGNTWQRTPLVLGKDTSADSLHAMLVASCIPENLIPSQSEIDKWISHHTPAHRGEEIKNIPLRLKNGVPVKSIWKEASKGTLINSPMGWSGTMSDDGIFREARSLRSSNDRLELWIGWNAKKQVWEYQTRVVPTREAMAGIRRMGLPWRNTKNIPPYLQKILKQKKVSSLKELISGKLCPHSIHVADIRKGMVAKIEFEYDVKKCPSDKNGLKEVMWGEVTAILTSGKVECKSLIRKDMKPYSATNSLKIAMLFGFPPPDEFAKTHSLKP

SEQ ID NO: 14 - protein, 1206 aa, Unknown
  Description of Unknown: uncultivated organism
  MG1-11 effector
MNNTPLSPNTASAEPEPDRKLAAESAAENAQARAVAASWAQHPFFDDESIVLGLDIGMQGIGIAVRRGRQLLYAKTLMVELPESAPLRQRRQYRAARHARKNRKTRMRRLRELFLRHGLPWVSDEIYGRSDPYKLRARAFTPGKTLASKEALSLCIRSVVAHRGFDYYALCSESGGYPWGESSDMKDAARWLRTQYVTEETRDQLIGMAGAFSCFDEKEITDNHLLEWERLVRERCDDPNKPDLATLLRQYASSRPDDRRARGWNFPRSLMEDHLRTIINKHRHLIDDCDGFLAALFRPCDTKADKKRAIFHYNRKTPAEARARFERKIALCPYLSDPETAISLGHADAEGRPLPPEKCGTRGEAAICRWSMLDFLSTRRFELKPPKARGKDLAEPPLLRQTLPEATIRALDEALQEPVKPRWADLKSRLTKALKPFTLETNTKSPTNALLIEQLKDICCPSGPKAAARAGLSARAAELLIGVITGRSNPAGEASDTPPAPSYDPRQLEERKLAWGLYEKRARIDASRTGIYPQVHTLLGTLRVHRKSAEDSAFSTRGLLQRLFEGELRESLGGKTRPDYCIIECIKNPACNTKQASEIQKQNDARRKRKEELCRAYGCANPTHAEMLRLQLFEEQGGKRKGEAPAICPFTGESLGTDPLSPHLELAHIFPDARGGLYIRENLVLTTARTNRDMNNRTPIEAAEASLPGWSRWETIEQRIRHFRWNAKKLELFTFRPTPEQPIPDFNNMTRTAQLARELRRYIAVWMGINRDVDAVRERIGNPCGSYTAAARRGMLPADYRKDRSNNLHHRIDAAVLTCIPPAAGLNNLRCGGIFRNTRINGKRCTTTIPGLPLPDFGALIADDSTCPLVSRRRTGSTRQSLGDSTFWGVNSQGDLTQRTPLVYDKDTSVESIAQDLVRTGIRAEEMPDQDHIEQWLLRMSQAQQEEREGRDAAGPAPTLRLKNGRPIRSIRKGSKKGEIAVSPLGWSGIIEPRSESPAGDGAPAAEATSGRGRDRNRAAITAPNRFIALRCLSSSNDRLELWLGHDGKKWKYVTRVIPTKQALAGLKRMGLPWRGRERAPLYLIRLLDAARCRDLKQFICGTLPPHAVKVATVRKGDFFRATFNLKPKKREEQHSHTACLDTPATLTGWGKVTALMTKGQIGISPATHQGYEKTSVRGPSRLAKMLGLQEDAAAEAESRGLLPRP

SEQ ID NO: 15 - protein, 1244 aa, Unknown
  Description of Unknown: uncultivated organism
  MG1-12 effector
MDYIIKPAPGSTSSPYDWANDPFYKSAIVLGIDIGIEGIGVWLRKGRNHVFARTFLFNTPEAAPLKGRRLLRGGRRCRQSEQHREVLLKQFCAEFGLPWTEIKDQENEDGPFKLRLRAVRSKLGSKEALVVCLRHIIRHRGYDYHETDGGSFPWGDELKADVATGWAKAAYCSPEDAAEFLHDVSDCGWNDKQLASFRHALTAAVERHKQGIEAALEKHFAQDKNNLRIPARKHNFPRSLIWKHMEKICANHRDFLGGEAGLSAALLKLKPILNYHRKKPGALAERKVNRCPVAIHLFGGTAPKCDPNSNPHIRRFKLLEFLATRSFVAKDGTRLLANADLMKWLLDEVLAEDIRAVVVNKVKGGQKQERRKFGGFRDEFIARFDPNGKIELAGDRVSHNKDFFEQLGDLLRPKLSVLNARASICGKSAEELFKRATKDGYQAEIISRNLKEKQFDGQSFYTLRQAAAAGFGIYPQVEFLLGRRGKKGNQAVPGVLRQMLELPEVSAKLDGQKIPDYVIIETVGDMPRNVVQAKEIQDEQKRRREFKEGLFEKFGVHDKQQDSEARKRVLLYDQQGGNRGEAICPYTGEPLGDPLSPKLQIDHIFPESLGGISEMVNLVLTHETTNNQRKGNQTPYQAFGGQQNTAEWQALVARVQKMGWNKQKRELVLREESSCPEWDNMTRIAQLARQLREEAARWLGVFGDDAKVRQKIGTPTGYQTSVCREAWSENVPKKDRTNLRHHLWDAAVISHIPPDRGMQLSHCGGIFFHAGEKKNGNILMRALPGLGPDLNSFENATKDQCLVEKKKTNRSKKSRFQQWIYGFPDKNGQMWARDSLKSLADKANLLELLRDAGIGENQLPTSHFEEWQEKRKAQFFTREEAWAAVEALALPPEQKIPEPIFEEWWSYRFSGDKRKVDEKLLRILIAKAGVKESVSKERLASVLTNRGDPGPLTRKDGTPINGVSGTAKQMTPMAIIPHRNHKREIIGFKLATESFVRAEIWVTEKPTKDGNAELNYHCRLIPHPRGLANLRQRVMQCTGKQLTWERRLTDEELRELGLLKELAALKREQEKISATHAKAVQKWQKEQQAKTNTLDLASSPSVQPIELKLPWLSLRKCYAGLPLYARRLTNKHGADISRIAKDDLLRVPLNSEGDICKREESAYQTLWYRVSAINKSGKIEMKMAERKQIKPPSERELRDGKRKPLTTDELWRVYAYTKEPSSTDVLAYLLEITRGNDQPPHPVK

SEQ ID NO: 16 - protein, 1294 aa, Unknown
  Description of Unknown: uncultivated organism
  MG1-14 effector
VWAFDLGKGSIGEAVRQGNDFKHKESLLIPHELARRGPAAVSGTPANKYRAKKTREAHLERERWLDTIWKVAGLTPLQARAVWENPETQKWELKHKGDYRLEREFAPKQFKKGAGGELVPIKYPNGKATDGAPAEKKADFETCYTSALLRIRLLQGDPSLKDWQIFKALRAALQSRGYGPVPWATKEARKQGRTPEELAREEEKKLQSADPRYREAVNKWQAFKDSVPKAFHFPCYFDAWKLGLWLHAKPDELGCRINHLAESTRNIRFDRADVRVELIRLGDQAAEILPALKKAFSDWQSGGWKYQHPVTGEKLTYPLRAKTFGEFLCDGPAGTPDESSFEAFLDQRHKAGLNRGSFEEWMAALGQKTPSFDNRILNNCVLIPRFHVCKMDVRLVMDEQGKLTGQIVTESLLATEVTLLLKLKNILVADPSAKDGQRKLTVGEVQDILAYAHRRLAELELVAADGTLLNLWPSKVAQRFSISKSSWRDVAVEAEFLRRMTASNIVVGSETRRLTIAEASSLLRAIANPKKGLEAQLPKDLQLLTKTAKSEFKKAKTASDEKTLRPMPGHEEVKAPKSSGRCGYSRVALRILKELILSGQAPSAFHSRLRELDTELLRKLGSSPEKPLVLIDDSKSQDQEQRKKENIENGKRGLLVSELNFLRQMRKERATEDSWENFFIPSQTIDALQQRHTQDGKLDSQSAIRELLGTINDPIVRHRLGVLAERLRKLQCGDEKRDSPGFGVPDAIVLEFVREDFMGEEAKREYQNFINEREKDRKAAREEAGKLGFDSRSSGLRYELWKAQGCCCLYTGRALAETELDQYEIDHIVPRSLGGPDAIVNYALTFHDINHTKEKGKLTPFTLLHGKPGWAEYLLRVDARATFLRNKKVQLLTRPDAAELVQRYTALAETAWISKLAQAIVNLQFGWTNGYDEKRERRVIVVSGGLTARVRRKYGLDKLLYNDVTDLEVLAKKVKNRDDKRHHALDAMVMTFIPQWARNPDQEGFFRFPREFRDASGREDYQKVRQLFAKHLSEVMPTNIAFERAALADTSFGLRVEGGKRIIVKRVSLFDLAQEPAGAPGKTKFSSKYLLKKIEWVRDATIRRRVKEEFLHKEPTEPNWQKFCDSFRQNSRNGVPGARIMKVWVYAGEPNEFKDLSKDGEGAMRKAKDDHQGQIIYTANDGELAVNPVYAHASITREMKRLRESGSKAKVHCFVRSKCIFHLRKAVPQPEYKLVVKNEQKQKRRIPATLALAPAKFMLNTIITDSMDVEFSAANGQRLVAPLRVLIDAGFEPV

SEQ ID NO: 17 - protein, 1010 aa, Unknown
  Description of Unknown: uncultivated organism
  MG1-20 effector
MNTKKIIFGFDVGLGSLGEAVRQGDKIIHADSLLIDKEVAEIKDQAERRRQYRTRTTHKEREKWWKKIWKMIGKQPLKGIEVFKDKNGNWQAEKGDEKLEREFPKKGDDTVYTSCLLRILLLQGEKLKDWQIYKAVRSAFMRAGYPNVPWAKQDEKEEEKRATEFTEMLEKIFTNLDYRFPCYYDAYQMEIFDAETGEIEIRQKKKANRARGYTAPRDLVEKELRLLLEQAAKQIPDLKNMPAKDWKDYILFGLKGDEKLQNKQWKGFYDTKIRGILDQKKAKFDNRCVNNCSQIPRFRVSRTKNILYFQTHLLLKLCNMMVEKNKKNEKLTPEERQEWYEKAEGERKQYMKDFFAKGGKKLTEDDYKKIANKYKITKTQWKKWCEKKGYKTYPGTCEIAAPKISGRTGFSRPAMLLLREFILSGLGAHDFRKKVLLENFKGFEKYKLHKEDLDFLKNIKGNDPQNIYLPSISLKEKFLDKNTGDIEDAVQKLIGSTRNSVVRHRLSVFFKRLQELEKKFGTPDNIVIEFAREDFSTKDSKKKYENDSKTNNKLFLEAKKKLRDNFGIDYRKQNENLVRKYMMWEKQGHICPYTGQPLDFEKLPEYEIEHIIPRGNKWNGPDDIKNTVLTTSAENRRKGENMPFEYIKNEEWESFKNRVNNMNISGKTKNILLARTEEEVEKLINRYYGLAVTGWVARMARDIACLWFGWEPGAEGEQRKLHTVSGSLVGKVRRKFGLNKALNPFLSAADAKKDEKNREDKRHHALDAMVMTYLDEYMRNPRNFSKLQKELGEIFGKLGGAQYFEEKLEDVIPHKIARNKARLEAQAISSVKKKISELKKTDIESIIDYKMKIEIQEIGLKNFQKKHSKEQKILLKPNGAINLSKDKKSRPRWYVTKTGEGFSYEGHYIFKERNNENFKICPVKAFESSWQVFRKLKNKGYEIKDNALFYAGCIIEITKPIPKKDIDVGFYEIKSLKPSDHRIQLKSLKRGEVFPLFAISYLKNNFHFVQ

SEQ ID NO: 18 - protein, 774 aa, Unknown
  Description of Unknown: uncultivated organism with predicted taxonomy: Candidatus Peregrinibacteria bacterium CG10_big_fil_rev_8_21_14_0_10_54_7
  MG1-21 effector
EKLEREFPKKGDDTVYTSCLLRILLLQGEKLKDWQIYKAVRSAFMRAGYPNVPWAKQDEKEEEKRATEFTEMLEKIFTNLDYRFPCYYDAYQMEIFDAETGEIEIRQKKKANRARGYTAPRDLVEKELRLLLEQAAKQIPDLKNMPAKDWKDYILFGLKGDEKLQNKQWKGFYDTKIRGILDQKKAKFDNRCVNNCSQIPRFRVSRTKNILYFQTHLLLKLCNMMVEKNKKNEKLTPEERQERYEKAEEERKQYMKDFFAKGGKKLTEDDYKKIANKYKITKTQWKKWCEKKGYKTYPGTCEIAAPKISGRTGFSRPAMLLLREFILSGLGAHDFRKKVLLENFKGFEKYKLHKEDLDFLKNIKGNDPQNIYLPSISLKEKFLDKNTGDIEDAVQKLIGSTRNSVVRHRLSVFFKRLQELEKKFGTPDNIVIEFAREDFSTKDSKKKYENDSKTNNKLFLEAKKKLRDNFGIDYRKQNENLVRKYMMWEKQGHICPYTGQPLDFEKLPEYEIEHIIPRGNKWNGPDDIKNTVLTTSAENRRKGENMPFEYIKNEEWESFKNRVNNMNISGKTKNILLARTEEEVEKLINRYYGLAVTGWVARMARDIACLWFGWEPGAEGEQRKLHTVSGSLVGKVRRKFGLNKALNPFLSAADAKKDEKNREDKRHHALDAMVMTYLDEYMRNPRNFSKLQKELGEIFGKLGGAQYFEEKLEDVIPHKIARNKARLEAQAISSVKKKISELKKTDIESIIDYKMKIEIQEIGLKNFQKKHSKE

SEQ ID NO: 19 - protein, 774 aa, Unknown; identical to SEQ ID NO: 18
  Description of Unknown: uncultivated organism with predicted taxonomy: Candidatus Peregrinibacteria bacterium CG10_big_fil_rev_8_21_14_0_10_54_7
  MG1-22 effector

SEQ ID NO: 20 - protein, 809 aa, Unknown
  Description of Unknown: uncultivated organism with predicted taxonomy: Candidatus Melainabacteria bacterium
  MG1-23 effector
MSKKVFAFDLGKASVGYCVREGFDIRKVGSIIIEKDHAEITTNRDRRRVKKTLEAHKAREQFFKKLWQNAGLETLDKEDERFKKEFGNKKDKNIYTSCLLRIALLQNKKLEQWQIYKALFNAFQRRGYDANLAWANAKTDDDKKNAEYMAKYTKENNVELINNDDFKFPCYYDAKRLGLWSEENPSELKTTIPLTGSKKVRTNGLVAPRELVEKELKQLWLNAQKQLPQLQNIDAEYFLYGDYRQAYGSYVVKEFRKFRGTKNDWQGVLGQKIPRFDNRIIAKCKLLPKRNVCKANTLENVSLVLLMKLKNLRLTDNMGEKFLLSPIDIKKIYENWLIKAKIDTNEEKLDTTITKKEIETVLNRKIKDKIDPMKANISGRSSFCRRACKIMTKIILSCELYPQNVDITEFVDKPNTQNPITIEEINTMISKIGDWNNLYIPDNRDEMAENSSDNREQTDTLIGNITNPIVRNRLQIFRDLILNLKQEYGTPNEVIFEFVRDGADNSLFGAKKANDTLKVMKENEKDNEQIVSELKDANALSSENILKLKLLKKQGLKCIYSGKSIAISNFDACEIDHIYPRSMGGNDALYNKVLCYSMENQKKAGRTPYEWLHKDEKTWFDFVNRLEAIKDTLGKKKYELLTSKPEDCKILIDSYNGLAETAQIARIAQQITALVFNWGLQVEGENRHIFVNNGSSTASIRRTYKLNKLLGDDVKKNRDNDKHHALDAICISFSRDYKYNKEKKVDEIEGLNPEIIKEVINNLMPYPYANDKTFKGNIKPLESIYGKRVKNGNTYLTKRADITSLEPKE

SEQ ID NO: 21 - protein, 1036 aa, Unknown
  Description of Unknown: uncultivated organism
  MG1-24 effector
MGKKVFAFDMGKTSIGFCVREALEIKEANSIIIDKEHSDISSIRERRRVKKNLEAHKAREAFFINLWKSCGLIPLDTKDENFKKEFATKHEDVIYTSCLLRIALLQNKKLEQWQIFKALYNAIQRRGYDTNLAWKSAQSDDDKENQELVKKYTQENGIEMIQNEEYKYPCYYDAKRLGLWNETTPKVCKRTLNNENLIKIRTTTYVAPRQLIEKELCNLWKNAQAQIPELNKYTVEEFLYGEYKEPYGSFVNPKFKQYMGTNHDWQGVLGQKIPRFDNRIIAKCKLLPKRNVCKANTIENVSLVLLMKLKNLRLTILDGSKRILAPAEIKHIYENWLSKVEQNVIKMQEKCKKENKTPDKEDKKLDTTITKKEIENVINQVISDKIEPLKANISGRSAFCKRACQIINKFILGGYLYPNEMDITEFIDSENRPNGITKAEIQNMLSKIGDWNNLFIPDNRGETIDNSENIRVKTDLMIGGITNPIVRNRLQIFRDLLLSLERDYGKPDEVIFEFVREGADNSLFGKAKAQAAETNMREMEKRNQQLIEELKNYDAYSSKNFEKLKLLKIQCGQCAYSGEKIGIGDFNKCEIDHIYPRAMGGNDALYNKVLCYRVENQKKQDRTPYEWLSSNKEQWANYVFRLNKIKQSLGKKKFELLTSKPEDCAKLIDSYNGLAETAYIARVAQQITAFCFGWGLQVEGEKRHIFVNNGSSTHAIRRRYGLNSLLGNDIKKNRDNDKHHALDAICISFSRDFKYDEKSKVDVIDGFTKEMVKKVLDEIIPYPYTNKKPFKGNIRPLETIYGLRTYGNNSYITQRIPLESIEQKDKKIKTIIDEAIKNDLLEKLTQKMDSKDWIKMLQNYVHPTKKTKVKKVMVVVSEGKIEKDSNGKERIGEFCDFGTKGTNHQFKHSKGHKGQILYFNEKGSVKVMPIYANIKTQDVKDKLLALGCKLYNKGEMFYSGCLIEVEKPFNATVYYKETDENGKDKTISVKQEVPAGIFKLRTIMSNGAIKLENNCGMEILSSAKVLVEANMKKYKN

SEQ ID NO: 22 - protein, 1027 aa, Unknown
  Description of Unknown: uncultivated organism
  MG1-25 effector
MVKKIFAFDMGKSSIGYCAREGLKVLELGSLIIDKDHAEIVSNRDRRRVFKTLNAHKAREKFFNDLWKSCNLEPLEKEDKLFKKEFGKKDEETIYNSTLLRIALLQNIELEEWQIYKALHSAIQRRGYDTSLAWANANTDDEKENKKRTLEYTTNKENDELISQEEYKYPCYYDAKRLGLWEEENPKTLKTYVDVYNNDKIRTAGIVAPRNMVEKELKQLYINAQKQLPELNKYSADYFLYGVSEKAYATYLDSDYKKYRGTNWEWENGGVLGQKIPRFDNRIIAKCKLLPKRNVCKAETVENVSLVLLMKLKNLRFTDVLGEKSMLSAEAIKQIYENWQKKATKNDGSIKLDTTITKQEIEKVIGEKILEKFEPMKAKLSGRSSFCRRACKIMCKIILEGIENPATMDVGEFIDNIDVKNGITEKEIRTMLSKIGTWDNLYIPDNRYEMAEISSDEREKTDILIGNITNAIVRNRLQIFRDKILELKYKHGTPDEVIFEFVRDDNSLFGAKKTQEYISNINKNQKENEEIAQQLKDANCFSSKNLEKLKLLQKQGGHCIYSGRPIAISNLEECEIDHIYPRSRGGNDALSNKVLCYAIENQNKKEQTPYEWLHNNEHSWNEFVKRVTNKQEALGKIKVKLLISKPEDSEKLIKSYNGLAETAQIARVAQDITAFVFGWGLQLEGEKRRIFVNNGATTSAIRKTYRLNKLLGNDVKKNRQNDKHHALDAICISFSRGYKYNATTKRDEIEGLDIHDNEFRDLVKSSIDSLLPYPYSNDKPFKGNIKPLETIYGYRKLGEKTYITQRVDITSIEQKDKKIKSIIDEIIKNDLLAKLEDKMTSKEWANMLSKYVHPTKKTRVKKVLLVVSEGITNFDENGRARIGEFVDFGTKGTKHQFKHSKGHKGQILYYNEKNAIKVMPIYANQKLGEVKDKLEQMNCKLYKKGMMFYSGCLIKVDKEFEGTAYYTIADENGKEKQTPKKEILPAGIYKLRTLKSDGRVQLESSVGIEIWTNAKNLVDTDFKKLTK

SEQ ID NO: 23 - protein, 1025 aa, Unknown
  Description of Unknown: uncultivated organism
  MG1-26 effector
MKKKVFAFDLGKASIGYCVREGFEINEANSIIIDKDHAETMSLRDRRRIKKTLDAHHAREEYFNKVWSGVGLNILDKNNNNFKKEFPSKNEDIIYTSCLLRIALLQNQKLEQWQIYKALYNAFQRRGYDVNIAWKSVQTDDDKENIERMKKYTCENDIELIISDEYKYPCYYDALRLGLWNEDEPTKLNHSIPQHNSNKIRTTEYVAPRELVEKELKQLWLNAQLQLPQLNSISPEEFLYGEYKVPYGSCTEKEFKQYRGTERDWQGVLGQKIPRFNNRIISKCKLLPKRNVCKANTLENVSFVFLMKLKNLRFTTVSGEKLRLSPTEIKQIYENWLLKVENAYDKDIEKANNLGKEKPEKRLNINITKKEIENVICNEIIDKIEPMKADISGRSSFCRRACQIMNKIILDGELYPQNVDISEFVDRDNVKNGITEEEIQSMLSKIGDWNNLYIPDNREENAQNASNSRTKTDIMLGNITNPIVRNRLQIFRDLLLDLAEKYGTPDEVIFEFVRDGADNSLYGSKKAQDTEKYMKQQEKENEQIIKELKEAGLYVNGQNHANATYFLMHKLLKSQGGACAYSGQKIAPSNYDECEIDHIYPRTLGGNDALYNKVVCYRRENQDKKGRTPYEWLSSDNDKWANYVNRLNKIKKQLGKKKFELLTSKPEDCEKLIESYNGLAETSHIARVAQQMTAFIFGWGLQVQGKNRRIFVNNGSSTCAIRKRYDLNKLLGDDRKKNRENDKHHALDAICISFSRDFKYDKEIKKDIIKGFNPEIVKDAIDKIMPYPYANDKPFKGNTKPLETIYGLRTYGEKSYITQRVELNSIDKKATKIKSIIDETIKNDLLNKLEENPTEQEWKLMLQNYIHPKKQTKVKKVMIIVSEGEITKDSNDRERIGEFVDFGTKGTQHQFKHSKGHKGQILYFNQKGIVKVMPVYSNIKITDIKDKLQNMGCKLYNKGQMFYSGCLVDIPKPFKAGSKEHPAGCYKVRTITLGGQIKLEDNCGIEILTSATYLVQAGFKKVESK

SEQ ID NO: 24 - protein, 1028 aa, Unknown
  Description of Unknown: uncultivated organism
  MG1-27 effector
MNKKVFAFDLGKASIGYCVREDLKILEAGSLIINKDHAECISNRDRRRVQKTLLAHKKRESFFNNLWQNCDLNILNKDDKRFSTEFGKKNDSTIYNSTLLRIALIQNKPLEEWQIYKALHNAIQRRGYDSKLPWANAKSDDDKKNEELSARYTQNEQGEELIKNENFKYPCYYDAVRLSLWSENMPEKLQTYVPLDNVKKIRDAGIVAPRNLVEKELKQLYINAQLQLPQLNKYSVEYFLYGEGEVAYASYNKKDYKCHRGTEWDMQGVLGQKIPRFDNRIIAKCKLLPKRNVCKANTLENVSFVLLMKLKNLRYTNINNEYSMLSADTINKIYQNWLNKALKDDGSYKLDTTIIQKEVEKVLGEKIQDKFEPLKANISGRSSFCRRACKIMNHIILNGIEDPTTMDVAEFTDNIDTPNGITEAEIRTMLSKIGTWENLYIPDNRYEMAELSSDNREKTDILIGNITNPIVRNRLQVFRDKLIELKQKYETPDKIIFEFIRDGADNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSKPENCEELIKSYNGLAETAQIARVAQDITAFIFGWGLQLKDEKRRIFVNNGASTSGIRKTYRLNKLLGNDVKKNRNNDKHHALDAICISFSQNYKYNKHTKRDEIEGLDIHDNEFRELIKQTLDAIIPYPYTNDKPFKGNTKPLETIYGYRCIDNKHYITQRVSLETIEQKDKKIKCIVDEVIKNDLLEKIKEKMPTKDWTTMLQNYIHPTKQTKVKKILVIVSEGELTKDSNAHSRIGEYADFGTKGTKHQFKHSKGHKGQILYYNEKGVIKVLPIYANQKDSDVKSYIEQNGCKLYKKGMKFYSGCLIQINKDFEATAYYTQTDENGNDKQIPTKEKLQAGVYKLRTMMIDGKVKLESSTGIELLTNAKVLVEADFSKFSKY

SEQ ID NO: 25 - protein, 1036 aa, Unknown
  Description of Unknown: uncultivated organism
  MG1-28 effector
MGKKVFAFDMGKASIGYCAREDFEIKEANSIIIDKDHSDISSIRDRRRVKKTIIAHKAREQFFVNLWKSCNLTPIDTKDDNFKKEFANKKDSTIYTSCLLRIALLQNKKLEQWQIFKALYNAIQRRGYDANLAWKSAQTNDDKENIELTQKYTQENGIELIKNEKYKYPCYYDAKRLGLWDENFPNRFNQAINLDNVIKVRTTTYVAPRQLVEKELKQLWINAQIQIPELNKYSVEEFLYGEYKEAYGSYVNPEFKKYMGTAHDWQGVLGQKIPRFDNRIIAKCKLLPKRNVCKANTIENVTFVLLMKLKNLRITNNLGEKIILSPEEIKHIYENWLSKVEQNVIKMQEKCKKENKTPDKEDKKLDTTITKKEIENVINQVISDKIEPMKANISGRSSFCKRACQIMNKFILGGYLYPQEMDITEFIDSENSPNGITKQEIQVMLSRIGDWNNLYIPDNRGENINDSEKIRTNTDLIIGSITNPVIRNRLQIFRDLLLSLEKDYGKPDEVIFEFVREGADNSLFGKAKAQAAETNMKAMEKQNQQLVKELKNYDAYSSINFEKLKLLKMQCGQCAYSGQKIGISDFDKCEIDHIYPRTMGGNDALYNKVLCYRVENQKKQGRIPYEWLSSDKEKWANYVFRLNEIKKSLGKKKFELLTSKPEDCEKLIDSYNGLAETAHIAKVAQQIAAVCFSWGLQIEGEKRHIYVNNGSSTHAIRHRYGLNSLLGNDIKKNRDNDKHHALDAICISFSRDFKYDEESKKDIIKGFTREMVKKVIDEIMPVPYTNKKPFKGNTRPLETIYGLRAYNGKSYITQRVPLESIEPKEKKVRTIIDEVIKNDLLEKLNQKIDSKEWISMLQNYIHPKKKTIVKKVMIVVSEASIEKDSNGVERIGEFCDFGTKGTKHQFKHSKGHKGQILYFDEKGLVKVMPIYSNIRTQDIKDKLMTMGCKLYNKGEIFYSGCLVEIEKPFVATVYYKETDADGKEKTISVKQEVPYGIFKIRTIMGDGKIKLENNCGLEILSSAKVLVPLNMKKYKN

SEQ ID NO: 26 - protein, 1036 aa, Unknown; identical to SEQ ID NO: 21
  Description of Unknown: uncultivated organism
  MG1-29 effector

SEQ ID NO: 27 - protein, 1036 aa, Unknown
  Description of Unknown: uncultivated organism
  MG1-30 effector
MGKKVFAFDMGKASIGYCAREDFEIKEANSIIIDKDHSDISSIRDRRRVKKTLNAHKARERFLVNLWKSCNLIPLDTKDDKFKKEFANKKDSTIYTSCLLRIALLQNKKLEQWQIFKALYNAIQRRGYDANLAWKSAQTNDDKENIELTQKYTQENGIELIKNEKYKYPCYYDAKRLGLWDENFPNRFNQAINLDNVIKVRTTTYVAPRQLVEKELKQLWINAQIQIPELNKYSVEEFLYGEYKEAYGSYVNPEFKKYMGTAHDWQGVLGQKIPRFDNRIIAKCKLLPKRNVCKANTIENVTFVLLMKLKNLRITNNLGEKIILSPEEIKHIYENWLSKVEQNVIKMQEKCKKENKTPDKEDKKLDTTITKKEIENVINQVISDKIEPMKANISGRSSFCKRACQIMNKFILGGYLYPQEMDITEFIDSENSPNGITKQEIQVMLSRIGDWNNLYIPDNRGENINDSEKIRTNTDLIIGSITNPVIRNRLQIFRDLLLSLEKDYGKPDEVIFEFVREGADNSLFGKAKAQAAETNMKAMEKQNQQLVKELKNYDAYSSINFEKLKLLKMQCGQCAYSGQKIGISDFDKCEIDHIYPRTMGGNDALYNKVLCYRVENQKKQGRIPYEWLSSDKEKWANYVFRLNEIKKSLGKKKFELLTSKPEDCEKLIDSYNGLAETAHIAKVAQQIAAVCFSWGLQIEGEKRHIYVNNGSSTHAIRHRYGLNSLLGNDIKKNRDNDKHHALDAICISFSRDFKYDEESKKDIIKGFTREMVKKVIDEIMPVPYTNKKPFKGNTRPLETIYGLRAYNGKSYITQRVPLESIEPKEKKVRTIIDEVIKNDLLEKLNQKIDSKEWISMLQNYIHPKKKTIVKKVMIVVSEGSIEKDSNGVERIGEFCDFGTKGTKHQFKHSKGHKGQILYFDEKGLVKVMPIYSNIRTQDIKDKLMTMGCKLYNKGEIFYSGCLVEIEKPFVATVYYKETDTDGKEKTISVKQEVPDGIFKIRTIMGDGKIKLENNCGLEILSSAKVLVPLNMKKYKN

SEQ ID NO: 28 - protein, 1028 aa, Unknown
  Description of Unknown: uncultivated organism
  MG1-31 effector
MNKKVFAFDLGKASIGYCVREDLKILEAGSLIINKDHAECISNRDRRRVQKTLLAHKKRESFFNKLWQNCDLNILNKDDKRFSTEFGKKNDSTIYNSTLLRIALIQNKPLEEWQIYKALHNAIQRRGYDSKLPWANAKSDDDKKNEELSARYTQNEQGEELIKNENFKYPCYYDAVRLSLWSENMPEKLQTYVPLDNVKKIRDAGIVAPRNLVEKELKQLYINAQLQLPQLNKYSVEYFLYGEGEVAYASYNKKDYKCHRGTEWDMQGVLGQKIPRFDNRIIAKCKLLPKRNVCKANTLENVSFVLLMKLKNLRYTNINNEYSILSADTINKIYQNWLNKALKDDGSYKLDTTIIQKEVEKVLGEKIQDKFEPLKANISGRSSFCRRACKIMNHIILNGIEDPSTMDVAEFTDNIDTPNGITEAEIRTMLSKIGTWENLYIPDNRYEMAELSSDNREKTDILIGNITNPIVRNRLQVFRDKLIELKQKYETPDKIIFEFIRDGADNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSKPENCEELIKSYNGLAETAQIARVAQDITAFIFSWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDKPFKGNTKPLETIYGYRCIDNKHYITQRVSLETIEQKDKKIKCIVDEVIKNDLLEKIKEKMPTKDWTTMLQNYIHPTKQTKVKKILVIVSEGELTKDSNAHSRIGEYADFGTKGTKHQFKHSKGHKGQILYYNEKGVIKVLPIYANQKDSDVKSHIEQNGCKLYKKGMKFYSGCLIQINKDFEATAYYTQTDGNGNDKQIPTKEKLQAGVYKLRTMTEAGQIKLESSTGIELLTSAKVLVEADFSKFSKY

SEQ ID NO: 29 - protein, 1028 aa, Unknown
  Description of Unknown: uncultivated organism
  MG1-32 effector
MNKKVFAFDLGKASIGYCVREDLKILEAGSLIINKDHAECISNRDRRRVQKTLLAHKKRESFFNNLWQNCDLNILNKDDKKFSTEFGKKNDSTIYNSTLLRIALIQNKPLEEWQIYKALHNAIQRRGYDSKLPWANAKSDDDRKNEELSARYTQNEQGEELIQNENFKYPCYYDAVRLSLWSENMPEKLQTYVPLDNVKKIRDAGIVAPRNLVEKELKQLYINAQLQLPQLNKYSVEYFLYGEGEVAYASYNKKDYKCHRGTEWDMQGVLGQKIPRFDNRIIAKCKLLPKRNVCKANTLENVSFVLLMKLKNLRYTNINNEYSMLSADTINKIYQNWLNKALKDDGSYKLDTTIIQKEVEKVLGEKIQDKFEPLKANISGRSSFCRRACKIMNHIILNGIEDPSTMDVAEFTDNIDTPNGITEAEIRTMLSKIGTWENLYIPDNRYEMAELSSDNREKTDILIGNITNPIVRNRLQVFRDKLIELKQKYETPDKIIFEFIRDGADNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSNPENCKELIKSYNGLAETAQIARVAQDITAFIFGWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDKPFKGNTKPLETIYGYRCIDNKHCITQRVSIETIEQKDKKIKCIVDEVIKNDLLEKIKEKMPTKDWTTMLQNYIHPTKQTKVKKILVIVSEGELTKDSNAHSRIGEYADFGTKGTKHQFKHSKGHKGQILYYNEKGVIKVLPIYANQKDSDVKSYIEQNGCKLYKKGMKFYSGCLIQINKDFEATAYYTQTDKNGNDKRIPTKEKLQAGVYKLRTMTEAGQIKLESSTGIELLTSATVLVEADFSKFSKY

SEQ ID NO: 30 - protein, 1028 aa, Unknown; identical to SEQ ID NO: 28
  Description of Unknown: uncultivated organism
  MG1-33 effector

SEQ ID NO: 31 - protein, 1025 aa, Unknown; identical to SEQ ID NO: 23
  Description of Unknown: uncultivated organism with predicted taxonomy: Candidatus Gastranaerophilales bacterium HUM_9
  MG1-34 effector

SEQ ID NO: 32 - protein, 1027 aa, Unknown; identical to SEQ ID NO: 22
  Description of Unknown: uncultivated organism
  MG1-35 effector

SEQ ID NO: 33 - protein, 1011 aa, Unknown
  Description of Unknown: uncultivated organism with predicted taxonomy: Clostridium
  MG1-36 effector
MRYRIGLNIGINSCGWAVIEHNEDGEPIKLENMGVRMFEISENLKDGLSLSKAPRETRSIRRRIRRRKHRIERLKYLIVNSNMLTQEEVNNLYNSTNLENIYLLRVRALSEKISNTDLTRVLINLMKKRGYKSNVELEDYAKDEDGKVLTATKENQKIMKEKGYSTVAEMYLKDKKFKMILPDGTIIYKIRNTTGNYSSTVLRNQIREELIRILIKQQELNDLVTNDFVQKCLEIFDSQRPYDEGPGLRYSTTQVDKMLGKCIFEKQENRAVKASYSFEYFDFLKQLNNIIIEKTIITSNNKTTQKRKLSKEERQKIIKLAKYQSQIRYYDIRQELQLSDYERFCNLEYSSISEFSESINKLAERKPKLEGFTSYFRIKQALYYVDNTLIERLSNEELDEIAYVLTVYKSNERRLEQFEIRNLHLPANAIQELLKISFIEIAYLSLKAIKKITPYIEEGYTYNSALEQAYPSFETSLCNINSEILNPVCRRAISQSIKVLKAIVNQYGKPDLINIEFSNELGKGKSEREKIKKQKQENLGKTSRIKEELQAQGIENPTGTEITKYKLWKEQTNYCMYSGKKIDIEQVFSSETQINYIIPFWMCFDDTYKNKILTFTSEVKQKQDLMPYQYIQKMRRDTEEYETRISMLIRVYSKKNRLVKKNITKEEMIKWRNRNIEDTQYIAKWITNYIRRNIQFVECSKYNNKVLIISSNLTSYINRKLDISNNIIIGNQKHALDALVTATVSKELLNKIIIYSRENTENSQFPIPWENFKQDMNNLPPIFVSRAPKRKVTGQAHDETIRRMQICGKEIKCISRTDIKKLKLNSEGEIENFSKNSKNTDKVLYNALKEEIKENGGNATRSFIKQFYKPKKDKTPGLPVKKVKLESKTRLPIKLKNQAIATNGSIIRLDVFKVENEGYYYVPIYVSDTVLPKLPNKACASSKPYEEWPEMREEDFIFSLYSRDLIYIKNKSPMNLHPTDGKRKHSNNRRNISVLHKGRYLRSNHKHNKQW

SEQ ID NO: 34 - protein, 1027 aa, Unknown
  Description of Unknown: uncultivated organism
  MG1-37 effector
MVRKIFAFDMGKSSIGYCAREGLKVLELGSLIIDKDHAEIVSNRDRRRVFKTLNAHKAREKFFNELWKSCNLEPLEKEDKLFKKEFGKKDEETICNSTLLRIALLQNIELEEWQIYKALHSAIQRRGYDTSLAWANANSDDEKENKKRTLEYSTNKENDELISQEEYKYPCYYDAKRLGLWEEENPKMLKTYVDVYNNDKIRTAGIVAPRNMVEKELKQLYINAQKQLPELNKYSADYFLYGVSEKAYATYLDSDYKKYRGTNWEWENGGVLGQKIPRFDNRIIAKCKLLPKRNVCKAETVENVSLVLLMKLKNLRFTDVLGEKSMLSAEAIKQIYENWQKKATKNDGSIKLDTTITKQEIEKVIGEKILEKFEPMKAKLSGRSSFCRRACKIMCKIILEGIENPATMDVGEFIDNIDVKNGITEKEIRTMLSKIGTWDNLYIPDNRYEMAEISSDEREKTDILIGNITNAIVRNRLQIFRDKILELKYKHGTPDEVIFEFVRDDNSLFGAKKTQEYISNINKNQKENEEIAQQLKDANCFSSKNLEKLKLLQKQGGHCIYSGRPIAISNLEECEIDHIYPRSRGGNDALSNKVLCYAIENQNKKEQTPYEWLHNNEHSWNEFVKRVTNKQEALGKIKVKLLISKPEDSEKLIKSYNGLAETAQIARVAQDITAFVFGWGLQLEGEKRRIFVNNGATTSAIRKTYRLNKLLGNDVKKNRQNDKHHALDAICISFSRGYKYNATTKRDEIEGLDIHDNEFRDLVKSSIDSLLPYPYSNDKPFKGNIKPLETIYGYRKLGEKTYITQRVDITSIEQKDKKIKSIIDEIIKNDLLAKLEDKMTSKEWANMLSKYVHPTKKTKVKKVLLVVSEGITNFDENGRARIGEFVDFGTKGTKHQFKHSKGHKGQILYYNEKNAIKVMPIYANQKLGEVKDKLEQMNCKLYKKGMMFYSGCLIKVDKEFEGTAYYTIADENGKEKQTPNKEILPAGIYKLRTLMSDGTVKLESSIGIEILTSAKKLAEADFKKLTK

SEQ ID NO: 35 - protein, 810 aa, Unknown
  Description of Unknown: uncultivated organism with predicted taxonomy: Candidatus Melainabacteria bacterium
  MG1-38 effector
MSKKVFAFDLGKASVGYCVREGFDIRKVGSIIIEKDHAEITTNRDRRRVKKTLEAHKAREQFFKKLWQNAGLETLDKEDERFKKEFGNKKDKNIYTSCLLRIALLQNKKLEQWQIYKALFNAFQRRGYDANLAWANAKTDDDKKNAEYMAKYTKENNVELINNDDFKFPCYYDAKRLGLWSEENPSELKTTIPLTGSKKVRTNGLVAPRELVEKELKQLWLNAQKQLPQLQNIDAEYFLYGDYRQAYGSYVVKEFRKFRGTKNDWQGVLGQKIPRFDNRIIAKCKLLPKRNVCKANTLENVSLVLLMKLKNLRLTDNMGEKFLLSPIDIKKIYENWLIKAKIDTNEEKLDTTITKKEIETVLNRKIKDKIDPMKANISGRSSFCRRACKIMTKIILSCELYPQNVDITEFVDKPNTQNPITIEEINTMISKIGDWNNLYIPDNRDEMAENSSDNREQTDTLIGNITNPIVRNRLQIFRDLILNLKQEYGTPNEVIFEFVRDGADNSLFGAKKANDTLKVMKENEKDNEQIVSELKDANALSSENILKLKLLKKQGLKCIYSGKSIAISNFDACEIDHIYPRSMGGNDALYNKVLCYSMENQKKAGRTPYEWLHKDEKTWFDFVNRLEAIKDTLGKKKYELLTSKPEDCKILIDSYNGLAETAQIARIAQQITALVFNWGLQVEGENRHIFVNNGSSTASIRRTYKLNKLLGDDVKKNRDNDKHHALDAICISFSRDYKYNKEKKVDEIEGLNPEIIKEVINNLMPYPYANDKTFKGNIKPLESIYGKRVKNGNTYLTKRADITSLEPKEK

SEQ ID NO: 36 - protein, 1028 aa, Unknown; identical to SEQ ID NO: 28
  Description of Unknown: uncultivated organism
  MG1-39 effector

SEQ ID NO: 37 - protein, 1028 aa, Unknown; identical to SEQ ID NO: 29
  Description of Unknown: uncultivated organism
  MG1-40 effector

SEQ ID NO: 38 - protein, 1025 aa, Unknown; identical to SEQ ID NO: 23
  Description of Unknown: uncultivated organism with predicted taxonomy: Candidatus Gastranaerophilales bacterium HUM_9
  MG1-41 effector

SEQ ID NO: 39 - protein, 1028 aa, Unknown; identical to SEQ ID NO: 24
  Description of Unknown: uncultivated organism
  MG1-42 effector

SEQ ID NO: 40 - protein, 1028 aa, Unknown; identical to SEQ ID NO: 28
  Description of Unknown: uncultivated organism
  MG1-43 effector

SEQ ID NO: 41 - protein, 1036 aa, Unknown; identical to SEQ ID NO: 27
  Description of Unknown: uncultivated organism
  MG1-44 effector

SEQ ID NO: 42 - protein, 1025 aa, Unknown; identical to SEQ ID NO: 23
  Description of Unknown: uncultivated organism with predicted taxonomy: Candidatus Melainabacteria
  MG1-45 effector

SEQ ID NO: 43 - protein, 1036 aa, Unknown; identical to SEQ ID NO: 25
  Description of Unknown: uncultivated organism
  MG1-46 effector

SEQ ID NO: 44 - protein, 1028 aa, Unknown; identical to SEQ ID NO: 24
  Description of Unknown: uncultivated organism
  MG1-47 effector

SEQ ID NO: 45 - protein, 996 aa, Unknown
  Description of Unknown: uncultivated organism
  MG1-48 effector
MNKKVYAFDLGKASIGYCARDGFNILELGSLIINKDHAEVVSNRDRRRAYKTLQAHKSREEFFIKLWQDCGLPVLEKNDKRFTIEFSKEKDETLYNSTLLRITLLQEKPLEVWQIYKALHSAIQRRGYDANIRWANDSDDEKENQERVTKYTQDENGIQIITNDAYKYPCYYDAVRLGLWDEKNPLEYKKHIPLQGVTKVRTTGIVAPRSFVEKELTQLYINAQKQLPQLEKYSVNYFLYGKYGKAYATFHKQEQGKEKDYGVLGQKIPRFDNRIIAKCKLLPKRNVCNAGTIENVSFTLLMKLKNLRFTNANGERCMLDSSAIKEVYENWLKKANKDNEIKLDTTITKKEIENVIGFKIQDKIEPMKTNISGRSSFCRRACQIMNKIILEGIENPATMDVAEFTDNVDSPNGITEQEIREMLSKIGTWENLYIPDNRYEMAELSSDDRQKTDLLIGNITNPIVRNRLQILRDKLLELKAEHGTPDEVIFEFVRDGADNSLYGAKKANGYLKNIKENEKENNEIKKELEEANAYSPTNFEKLKLLRMQCGKCVYSGKNISINDFDSCEIDHVYPRTMGGNDALYNRVLCYSIENQNKAGRTPYEWLSSDKELWANYVARLNDIKGSLGKKKFELLTSKPEVCEKLIESYNGLAETAQIARVAQQLAAFIFGWGMQTEGDKRHLFINNGSTTAAIRRRYGLNKLLGDDIKKNRENDKHHALDAICISFSKDFKYDHKSKKDIIEGFTYDFVKNEIDKLIPYPYANDKPFKGNTRPLETIYGYRKYGDKNYLTNRVDITSIEQKEKKIKTIVDEVIKNDLLEKLNLSSGDWAAMLKNYKHPKKHTIVKKVLTIVSEGTITTDSNNKSRMGEYADFGNKGVKNQFKHSKGHKGQILYYNEKGAVKVMPIYANQKLSEVKEKLLAMNCKLYKKGIMFYSGCLVSIPKDFKGGSNDYSAGIYTLKTIIADTGVIKLENLNGVEIGTSAKYLTDAEFRKYKN

SEQ ID NO: 46 - protein, 1015 aa, Unknown
  Description of Unknown: uncultivated organism
  MG1-49 effector
MKKFFAFDIGKKGLGYCCREGSKIHCAGSLTIEPDHSSVEDIRNNRKAIKTRIFHKAREEYFNKLWHDEAGLEILDKDDERFKIEFSKQDDERIYNSTLLRIALLQNRELEKWQIYKALHNAFQRRGYDSELPWKNSGTKADEENEKLAKNYTQKNGQKLIKKEKFQYPCYYDALALGMWKERNPSDLQRIVSKNPQKIRTGRRVAPRKLVIKELTDLWTAAQKQIPELQKISADKFLYGEYREPYASYTNPDWHKNMGKEKDWQGVLGQKIPRFNNRIISKCKLLPKRNVCSADTIENIVFTLLYQLKNFRYTNSNGEVGCRLAPIEIKEIYDNNIQNWMKNLYDNKKNNKSHTFTVSKTEIEKVIGKGQIYTTKNEKFKSFQANTSGRSSFCRRALQIMNEIILTGTDPKDVNISKFVDKSTTNNPITEDEIKEMLTKVGDWNELYIPYNSTRMAEFAQNPDIQSDLMIGSITNPIIRNRLQIFKNLLNDMIKKYGKPDEVIFEFVKDGKDNSLFGAEKAKATEQMMRINEKKNEEIRNNLSDDYSAINFLKYKLAEMQDWTCIYSGRKIEITDFDACEIDHIFPRTDDTNDALYNKVICYKEEIADKHGRTPYEWMNNNTARWQEYIMRVKSLSQKSGKTKTALLTLSPTQSEKFLEKRKALNETTQIAKIVQSVTASVLEWDLQVKDKNRHIFISDGSSTHKIRQQYKLDRLLDDNAKKNRENGKHRALDAICISYSKDFQYNTEQHKYEIENIDIPHIEDVINHVVPYPYTNDKPLKSALAPAGTIYGKKVKNGKTYITKRIALLDIKKDSKSINKISDNDIKSDLLNKSGKNLSDDNWVKILSKYTHPKRGTKVKKVIVLEEFKGQITFDSNGRERLGEYCDFGNKGTKGQFKHSKQHRGQILYFNEKGKIKVMPVYANKKVQDVKDELINMGCKLYHGGEMFYSGCLIEIPNDFKAGGNIQPKGIYKVSTITTAGLVKIENNSGNIVHTNSTHITEADFRKFIKRSNS

SEQ ID NO: 47 - protein, 1015 aa, Unknown; identical to SEQ ID NO: 46
  Description of Unknown: uncultivated organism
  MG1-50 effector

SEQ ID NO: 48 - protein, 997 aa, Unknown
  Description of Unknown: uncultivated organism with predicted taxonomy: Candidatus Melainabacteria bacterium
  MG1-51 effector
MNKKVYAFDLGKASIGYCVREDFNILELGSLIINKDHAEVITNRDRRRVYKTILAHKKREEFFNNLWSECGLTLLSKTDKRFTIEFSSSNDNTIYNSTLLRIALLQNKPLEQWQIYKALHNAIQRRGYDAEIAWTNDSADEKDNQKRVIKYTQDDLGNELIKDENYKYPCYYDALRLQLWSEKNPKDFNRHIPLTGSTKVRTTGLVVPRAFVEKELTQLYLNAQKQLPQLKKYTVEYFLYGKYGSAYATFRTPQQGKEKDYGVLGQKIPRFDNRIIGKCKLLPKRNVCKANTIENVSFVLLMKLKNLRFTDINGNKCKLGLSAIKDIYNNWYKESGNGKKLNTTITKTKIEKVIGCKILEDAKNINETLKANTSGRSSFCRRACQIMNKIILEGIANPLTMDVVEFTDDVGTANGITEQEIREMLSKIGTWENLYIPDNRYEMVELSSDDRQKTDLLIGKITNPIVRNRLQILRDKLLALKEKYGTPDKVIFEFIRDGADNSLYGAQKANNYLISIKANEKENNEIKKELEDANAYSNTNFDKLKLLRMQGGRCIYSGEKIGISNFEQCDIDHIFPRSRGGNDALYNKVLCYSKENRIKGDKVPYEWLNNTENWDIYLQRTRDLKGSLGKKKFELLTSKPDQCEKLIESYNGLADTAQIAKVAQQLAAFIFGWGMQTDGDKRHLFVNNGSTTAAIRRRYGLNKILGNDIKKNRENDKHHALDAICISFSQDFKYDPKSQKDIINGFTYDFVKNEIDKLIPYPYANNKPFKGNTKPLETIYGYREYNGKKYITNKIDINSLEQKEKKIKNIIDEVIKNDLLNKINLPSDEWKNMLQNYIHPKKQTHVKKVMVIVSEGDVTFDTNNRIRMGEYVDFGTKNVKKQFKHSKGHKGQILYYNEKGAIKVMPVYANQKLQEVKEKLLGMNCKLYKKGMMFTSGCLLEIPNEFYAGSNKYPAGIYKLRTIIADTCVIKIESSEGIEIVSSAKYLADAEFKKYKP

SEQ ID NO: 49 - protein, 997 aa, Unknown
  Description of Unknown: uncultivated organism
  MG1-52 effector
MNKKVYAFDLGKASIGYCAREGFNILDLGSLIINKDHAEVVSNRDRRRVHKTLLAHRTREEFFNKLWKDCGLEILDKSDKRFTIEFAKNNDSILYNSILLRIALLQNKPLEEWQIYKSLHNAIQRRGYDANLVWANDSDDEKTNKELAARYMQDEAGIELITNDEYKYPCYYDATRLGLWNEEAPNKFNRHIPLTDVTKVRTTGLVAPRQLVEKELTQLYLNAQKQLPQLNKYSVEYFLYGKYGRAYATFRKPEHGREKDYGVLGQKIPRFDNRIISKCKLLPKRNVCKAATLENVSFTLLMKLKNLRFTAPDGNKHMLSADAIREIYENWLQESNNGEKLNTTITKTKIEKVIGFKMLDDTKNINETLKANINGRSSFCRRACQIMNKIILEGIENPATMDVAEFTDDITAHNGITEAEIREMLSKIGTWDNLYIPDNRYEMAELSSDDRQKTDLIIGKITNPIVRNRLQILRDKLLELKSEYGTPDEVIFEFIRDGADNSLYGAKKSNDYLKNIKENEKENLEIKKELEDVDRYSPTNFEKLKLLRMQGGKCIYSGKPICIDDFDKCEIDHIYPRTMGGNDALYNRVLCYSIENQNKKGRTPYEWLSNDKEYWSAYVDRLNKIKGSLGKKKFELLTSKPEDCEKLIESYNGLAETAQIARVAQQLAAFIFGLGMQTEGDKRHLFVNNGSTTAAIRRRYGLNKLLGDDVKKNRENDKHHALDAICISFSRDFKYDEKSKKDVIEGFTYDFVKKAIDELIPYPYANDKQFKGNIRPLETIYGYREYGNKKYITNRVDITTIEQKEKKIKTIVDEYIKKDLLDKLNLSSSEWVELMKNYKHPKKHTIVKKVLTLVSEGEISKDSNDKSRMGEYADFGTKGVANQFKHSKGHKGQILYYNEKGAIKVMPIYANQKLSDVKQKLMSMGCKLYKKGMMFTAGCLLNIPNDFYVSENLYTSGIYKLRTIMSSGQIKIENSNGKEIITSAKYLTDANFLKYKN

SEQ ID NO: 50 - protein, 1015 aa, Unknown; identical to SEQ ID NO: 46
  Description of Unknown: uncultivated organism
  MG1-53 effector

SEQ ID NO: 51 - protein, 1015 aa, Unknown; identical to SEQ ID NO: 46
  Description of Unknown: uncultivated organism
  MG1-54 effector

SEQ ID NO: 52 - protein, 1015 aa, Unknown; identical to SEQ ID NO: 46
  Description of Unknown: uncultivated organism
  MG1-55 effector

SEQ ID NO: 53 - protein, 1003 aa, Unknown
  Description of Unknown: uncultivated organism
  MG1-56 effector
MTKKVFAFDMGKASIGFCVRDNHDIKEANSIIIDKDHSDISSLRDRRRVYRTLKAHHAREAFFNTLWTECGLSLLDKNDIRFTKEFSGKKDNTIYTSCLLRIALLQNKHLERWQIYKAIFNALQRRGYDPKLAWKTAQTDDDKENLELVEKYTQENGIELIQSEEYKYPCYYDATRLGLWSEEEPNKLKTCQPMNGIIKVRSTNYVAPRSMVEKELAQLWENAQIQLPQLKKYSTDYFLYGEYREAYGSYKNPDYRKFMGTEYDWQGALGQKIPRFNNRIIAKCKLLPKRNVCKAETLENVTFVLLMKLKNLRFTSPDGQKCMLSADAIKEIYNNWLMESDNGKKLNTTITKTKIEKVIGYKMLDNTKNINDTMKVNLSGRSSFCRRACQIMNRIILDGIEEPKTMDVAEFIDNIDTPNGITEQEIRTMLSKIGTWDNLYIPDNRNEMAEIADDSRTKTDIMIGNITNPIVRNRLQIFRDLLLRLKSDYGTPDEVIFEFVRDEADNSLEGQKRAKDTENYMKAQAKENEQIKKELEEQNALSGINFEKLKLLKMQGGKCIYSGQNIGISDFDKCEIDHIYPRTMGGNDALYNRVLCYRIENQDKKGRTPYEWLSHDEEQWAAYVHRLSEIKQILGKKKFELLTSKPEDCAKIIDSYNGLAETAHIARVAQQITAFIFDWGLQLEGENRHIFVNNGSSTCAIRKRYHLNSLLGDDEKKNRSNDKHHALDAICISYSRDFKYDKNIKKDTIEEFNPEVVKKVIDEIIPYPYANKKPFKGNTRPLETIYGLRYREKSYITNRVAITSIEQKDKKIKTIIDETIKNDLLNKLEEKMSSNDWINMLENYVHPKKRTHVKKVNVIVSEGKIEADKNGRDRIGEYSDFGTKGTQHQFKHSKGHKGQILYFNEKGAIKVMPVYANKSTKEVRKQLEQMGCKLYNGGELFYSGCLIEVPNEFKGTKSNQKHGIYKLRTMMSDGKVKLENNSGEEIMTSANYLVNAKFSKYKD

SEQ ID NO: 54 - protein, 1013 aa, Unknown
  Description of Unknown: uncultivated organism
  MG1-57 effector
MKKIFAFDMGKKGLGYCCREGSKINCAGSIIVEPDHSSIEDVRNRRRIIRTRNSHKSREKYFNKLWHVEAGLEILDNNDELFKTEFSKQNDETIYNSTLLRIALLQNRKLENWQIYKALHNAFQRRGYDSALPWKNSKTKDDEESEKQVKIYTQKDGKELIEKDEFQYPCYYDALSLGLWEEKNPYDLKRTISKEPQKIRTGGRVAPRNLVIKELSDLWIAAQKQIPKLQKISVEKFLYGDYREPYASYTNPDWRKNMGKKEDWQGVLGQKIPRFNNRVISKCKLLPKRNVCSADTIENIVFTLLYQLKNFRYTNSKGKVGCRLAPFDIKEIYDNNIEVWINNLEENKKNNKNHTFTVSKTEIEKVIGKGEIYTTKNEKFESFKANTSGRSSFCRRALQIMNEIILTGTEPQDIEVSKYVDKSTTNNPITEEEIREMLSKVGDWNELYIPDNRAEVAELAQNSDIQSDLMIGSITNPIVRNRLQIFKNLLIDMIRKYGKPEEVIFEFVRDGKDNSLFGAEKAKATEQMMKNNEKKNEEIKKNLGDDYSAINFLKYKLAEMQDWKCIYSGRKIGITDFAACEIDHIFPRTDDGNDALYNKVICYKEENADKLGRTPYEWLYHNIARWQEYVTRVKSLSQKLGKTKTALLTLPPEQSEKLLEKKNALNETAQIAKVAQSITAFILGWGLQVKGENRHIFVNNGSSTHKIRQQFKLNRLLGNDEKKNRENDKHHALDAICISYSKDFRYNTEKHKYEIDNLDIPHIEEVINSIVPYPYTNDKPLKSAVAPEETIYGKKIKDGKTYITKRISLADIKKDTKSINKISDEDIKKDLLLKSEQNLSERDWTNLLQDYIHPKRGTRVKKVITLEEFKGKITYDSNGRERLGEYCDFGNKGTKGQFKRSKQHRGQILYFDDKGKVKVMPVYSNKKVQDVKDELINMGCKLYRGGEMFNSGCQIEIPNDFKAGSNMYPKGLYKLSTITTAGQIKIENNSGNQLLTSATYLVQAEFKKSKKKR

SEQ ID NO: 55 - protein, 809 aa, Unknown
  Description of Unknown: uncultivated organism with predicted taxonomy: Candidatus Termititenax aidoneus
  MG1-58 effector
GEYEQAYGSYLNPDFKKYRGTNRDWQGVLGQKIPRFDNRIISKCKLLPKRNVCKSETIENVSFVLLMKLKNLRFTNLMGEKCILNSDAIKQIYENWKNKALKENGEYKLDTTITKKEIENVIGEKIQDKIEPMKANISGRSSFCRRACQIMNKIILEGIENPAEMDVIEFMDNIDSPNGITEKEIREMLSKIGNWDNLYIPDNRYKMAEISSDDREKTDLLIGNITNPIVRNRLQIFRDKLLKMKQEYGTPDEVIFEFVRDGADNSVLSGAKAEGYKLLCEQNYAKNEKLKNDLGDDFSPQNLIKLKLLESQNFQCIYSGNNIAPTDLDACEIDHIYPRTMGGNDALYNKVLCYSIENQNKKGRTPYEWFHQEKTEEEWIEYKNRCFNFLNKYPIPKKVKRRQDNHISKSIKEYYVKLSEYKLAKKKFELLTSKPEDCEKLIESYNGLAETAQIARVAQEITAFVFGWGMQTSGDDRHIFVNNGSSTSAIRRRYGLNKILGDDVKKNRENDKHHALDAICISFSRDFKYDEHSKKDVIKGFTYDFVKKEIDKLMPYPYANDKHFKGNTKPLETIYGYRRIDNKDYITKRISITDINKKEKVIKTILDKQIRKDLLDNLKLSDNEWKEYLSNYTHPTQKTIVKKVLTIESEGTLTFDKNNRGRIGEFADFGTKGTKYQFKHSKGHKGQILYYNEKGNIKVMPIYANQKKSDVIENLEQMNCKLYKNGMMFYSGCLIEISKEFIATVYYTIKDENDKNKQISQKETLNSGIYKLRTIKSDGTIKIENNNGIEILTSVKILSEINFKKYKKS

SEQ ID NO: 56 - protein, 1076 aa, Unknown
  Description of Unknown: uncultivated organism with predicted taxonomy: Verrucomicrobia
  MG1-59 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGMDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKIVVPVKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTAFAETAWISKLAQRICCLHFGFQFGGLTGAKKVWTVSGNTTAMIRGRYGLNRLLHDEESAADSLFDRICMEKKFEEKNRKNKKHHALDAMCLCFAPTSNAKKASAYKNILPEEITRNPESDEARKFFGKYLANVIPNKVAVEKPTLEQTIYAKRLIGGKETIVKKCNVRELAYTGINPKYNYSTLVKSIKSIVAEVPKRIISDFVLSNPNLSESEWEDWCKYEALIPSKNGAPTKLLRVLCDVGSPEEYKDLSKDGCGAYRKGDSHKGQFIWKTKQGRYVVAPVYAHASKAKVFAALKNNPDCAEVCGFFRQNCLVEIPNDVVDKSGKMLLKAGVYRSNTIKTDCRAKLTNSDGISPNPISIQYLMPAGMKRIKLDTL

SEQ ID NO: 57 - protein, 956 aa, Unknown
  Description of Unknown: uncultivated organism with predicted taxonomy: unclassified Verrucomicrobia (miscellaneous)
  MG1-60 effector
EFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSKTPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKEGGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 58 - protein, 1043 aa, Unknown
  Description of Unknown: uncultivated organism
  MG1-61 effector
MENKTVFAFDIGTGSLGTCVRKEKEILDLSVNLLPQDFASLKEAREKRRQIRTRIAHKMREKWWKEQAQKAGIEIPETGHLDEKGNFIKPDERMSREFPKEGDNTIYNSALLRIALLQGKKLEGWQIFKAIWSAIQHRGYDSNLPWINNPKRNVEEEGEENKDEKENKEAVKKYNNELKKVFGEGDENERFYYPCYYEAYKMGIWSKEEPENLNKKISNNPSPARNKDGKVDLVIPRELIEKEIKDMLIKAGDKYTYIKENLDYILYGPSKSKYAAYNLKEYKKYRGKDWEWQGLLSQKTPRFDNRLISKCVLIPRLNVCKAKDELNKEVTFLMKLNNMRYFEIKGGEEKKLNAEQIKQIFEKFKDKLKITKDQWSKYLKINFAAVPNPGQLKIDAPKISGRSSFCRPALGIIKELILSGKKPSELYKELTENNKNTDPKKGLIKEDYNFLLKLPDDYNFYISDSRDEESKLNESERKNKIDEIISEIINPVVKHRLKLFYDKLIELKQKHGTPEKIIIEFVRDPKEGFYGEKRRKEIIFEQNKKRKENDLAFEDAKKIGLKGKDAVLKIKLHKEQGGFDIYDGNPIKDNEIDNYEIDHIVPRESGGPDSYINKVLTSRKNNEEKGKRTPYEWLKDKNYWNDYVKRIKDSKTLNDKKKTLLTSSEAVNLAEKYTQLAETAYIAKMSQKIAHLFFGWSQGTLGSKKKVIVANGSLTAKMRGLYGLNRILHSGISEEEYKELVKSGKIDEKNRDNPRHHALDAIVLSMLPEIQMNDRKKDFFPIWFTPDYCRENLEKCFPKHIKYEKPKLAETIYGLRKVLDNGKERYVFVMRFGKGTKIEEYYDMDLAKKNLDSILSDKIKKDFSEKLSENPSAEEWKKFIDDYNAGGKVKKIILKCSSLIDPEEIKDFLEGKVRNYGEYIKGKMPGQYLKQKKDSYGYMVYKNEEGKWIRESIYAFDSVIKKQKEIKEKYKETYYFRSGMIVEIQETFEFDGRKEKIKVKKGKYYLKTIGFTNQVKIESIDSSSDFLINLKYLMENGKMKPVF

SEQ ID NO: 59 - protein, 1043 aa, Unknown; identical to SEQ ID NO: 58
  Description of Unknown: uncultivated organism with predicted taxonomy: Deltaproteobacteria
  MG1-62 effector

SEQ ID NO: 60 - protein, 833 aa, Unknown
  Description of Unknown: uncultivated organism with predicted taxonomy: Verrucomicrobia bacterium 61-8
  MG1-63 effector
DGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAALAGEIATQSAEAASGDSGAEERSRGKSQDVVQAPKPTGRSRFCRPALAILRHLLLHREKPQDFAARLRNREPALLDALDFDVLDNAPAEERPTGNGKALKGYRKQQRTWLLTGDLDFLDHVWKATDRDGNPRDFEPHQLRIPDMTLRDLRKRHDLTETPYSELLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLLEAQGPACIYTNKPIRCTDLPNLQIEHIVPRALGGPDAFWNWVLSDENANAEKGDRVPYVWFKEEKTDEEWADYKRRVLARAAHLGRRKVDLLLRPDAAELAGEKYTALAESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRTKEDFFRFPTAIGDNDFYSKEDQPEMAAIKSELAKLYVENKPVFREIKQARLAGDFGRLQQLKASVFPARKRIAELYRALDKLKQPRNVRAVREWFRAQLEGASPAPNGPVLPRTMAWQRTPTEATLYRRVYLIYKDCP

SEQ ID NO: 61 - protein, 1306 aa, Unknown
  Description of Unknown: uncultivated organism
  MG1-64 effector
IGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNPLPVARERSEAAALAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSELLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAQLGRRKADLHLRPDAAELAGEKYTALAESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSELAKLYVENKPVFREIKQARLAGDFGRLQQLKASVFPARKRIAELYRALDKLKQPRNVRAVREWFRSQLEGASPAAKRPVLPRTMAWQRTPTEATLYRRVYLIYKDCPERSLLALTDLAFAPNPRNPQQPVFDLKWLRTRIQSIAEHPGYDRKKLQSVLSAKLEATLSAKRFASCQFGPEDWQQICAQPEVAACFQPVGRGKSKRPPEPDQRLVKVCKVEVLPATRYELSELGYTSGNNYAWNPDHLAETARNILRKDDAQARTRGRRRTPAPASSPSADASPWPGFLWDREMQAKLASPKFREALEQQLVPHLLPPKPARMSDAERTDWATREERWKQAFEQFRKSHNLPKSFFVFTSDSDRPPRRPNVSLLRVLFEPKDKVFSRDALAKQAQSVVDAQLRRCLECFADSLTQVRDPRLQEKAWRDYCNVVRVVPKETLEQFTREHPTPTADQWISFFEAQTGPRIFQVMQTVGTSLEEYFDLSKDACGAFARGGNKGYWLCKRGDAIEARPIRFFENPEQVRVRLLGQGWELLDPKPWRTGDLLNLPEAAQSGARSVPAGYYFLGSFSNDTGVNLKPCFGGEVPQNVSLKALWNRGLRRCSPTA

SEQ ID NO: 62 - protein, 1150 aa, Unknown
  Description of Unknown: uncultivated organism with predicted taxonomy: Verrucomicrobia
  MG1-65 effector
ILPSGKAKDGAPAATEADLAICYNSALLRIKLLRGEKLEEWQIFKALRAALQNRGQQIVPWIAREAARTGKTPEELLEEEKKALKDKDPDDQSPMTKWQEFCQLDPIKNNHSLQYPCYYDAYKIGLWDPTQPNSFKNKPDHNAASTQQVVFPGDRIEAELLLLAQNAATQLPVLDHAYKKVIGEFLNDRRARIENINQKRAARAQARNQAPRLLSTENLPHAKNFAELFVYGPAGKPNLPNGYRNIALADASIARALVLRPGTDFDHQSAIGQKIPRFDNRILAHCALFPRFHVCKATPRIYPDNSVDADSLLPCEVTFLFKLKNLRVSRAGQVTSLTPQQIQTIFHHVRNTALSQLGAAQEPSAKALASKFSLTKTELTKWGKKPGMAFSLLPTQQEIEKPKFLGRSRFSKPALKIIKEIILFGKSPQQIAQELKAPNSPLAQQLQLKISPQSPMQGLTHHDLDILTKCGDSWDNFHIPDTTTDFLLSTNQNSSYPNQSDKDTLIKKYIATSNNPIIRHRLELFYERLRLHLEKYGKPDFIALEFVREDFLGEEAKKKIQKIQNENKKLNSQAAEKVEELKLAGRQSILKYKLWQLQGGICLYTGKPIAQTEIESHEVEHIVPRNHPQTQGPDAQWNLVLTAREINDRKANRTPFEWFQQDPIAFQWPMGQPDASIPSQEKQRLWEAYCDRIKQRKKNLGNKRVKLLLSDKAPELVERYETLATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEKARLAETAYGFRIINNKKKIAQRVAVEKLAYPGQEQKFDLAYLEGQIPSIADEKIRSMLTEIYNNIKSKTLQEAEQTWKDECAKLRLKTRDGSPGPFIKKVTQITDFHREYKDLSKDGTGAYYKGGDRHQGQFIYRDARGEFTVHPVYVHESIPQVKKALIEQNKTICIFVNSGCLVKTAQPIDPANYRKIIYENNKPKRITPEHPLPSGIYKWRTIIESSTSVTLENVFGEEFAINFCHLCKAGIQRL

SEQ ID NO: 63 - protein, 1076 aa, Unknown
  Description of Unknown: uncultivated organism
  MG1-66 effector
MADERIFSFDLGTGSIAYCVREGSNVIALGVDEIPSDFSELKDVRERTRQIRTRKAHKVREEWWKKHAELAGIEVPETGHLDEETGKFIPPDIRISTEFTKPGDSTIYNSYLLRIALLQGKELESWQIFKAIWSAIQHRGYERVPWINKEEDNEDTNKKRKSKSEGSEKEKEEREIQQAVVNYRNELKNAFGEKTQYYYPCYLEAYRLGIWSPDEPDNLTKTISDNPEPIRNKGGKIRRIIPRELLEAEIKQLLHQAGKKYPYIEENLDVILYGPAKTKYPAYTLKEYRRFMGKDWEWQGLLSQKTPRFDNRIIYKCRLIPRLNACKRKDPLAQEVIFLMKLKNFRYVDAETGEVLALKPEQLKTMFEEFQEEKKIGKRELEKFVKIRLNGKPHPGHTVIEPPNTNGRASFCRPALRIIKEILLTGKSPHQLYEEYTKANTNTDPRKGLVNDDYKFLLDLPAEWDKFHIPDRREEEAGLDEETRLKKIQELLGKITNAVVRHRLVLFYQKLQELKEKYGSPDKVIFEFARDPEETLDSKGRKERYKKVQDANRKAKEEAKKNLRELRNNGISIDGENALLKVRLWQEQNGRDLYTGLPIGQTEISICEIDHIIPREMGGPNAMYNFVLTKPECNREKGKRTPYQWLGSDPEKWQMFVDRINSEEYKKLSDRKKELLLKTITDEDELKELVEKYTHLAETSYISRLAQKIVHLYFGWEQLTKGSSRRVFVVSGAFTKRIRDLFKLDAILYPDLTLEEVYKYSAEEREEKNRNNPRHHALDALVVSITQEIKYNPLKGKDEYPEWFTPEFCKQAVERCLPVKVRFEKPTLAETIYGLRPYLDDNGRPTGKYVFVTRFGEGTDFEEYDDLDHAKKNVDSIYSANIRRELKQKLDENPSEQEWKIFIYNYRAGGKPKKLLMIASSDFAQEEVEKFLRGEINNLGEFIKGKMPGQYLKQSKESRGYFVYKDAKGKWRREAIYAFESPYLKKRKILSELKGRGDVYFFRSGVLVEIRNDIIKKQKPQSGNTETISKGFYYLNTIFETGYSKITSMEGKECLLSISKLMEEGKMKPAQEIRMR

SEQ ID NO: 64 - protein, 1655 aa, Unknown
  Description of Unknown: uncultivated organism
  MG1-67 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPAFGEKTKDGAPSDAAGANLCYTSCLLRIKLLRWKPGDPLLEEWQVYKALRSAMQKRGYGRVPWAVKEARAQGKTPEELEAEEQKQLEQADPRYREAAGKWPKFKRAVPAEFHFPCYYDAFHMGLWSPDQPDQLRLRPDHRAASTRNVRFDRADVRKELIALGNNAAAMLPQLQQAFERWQRDGWTFRHPVTGKALTKPVHARTFGEFLCDGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAAFAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSELLRQNSAELERRDKAIVELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLLEAQGPACIYTNKPIRCTDLPNLQIEHIVPRSFGGPDAFWNWVLCDENANAEKGDRVPYVWFKEEKTDEEWADYKRRVLARAAQLGRRKVDLLLRPDAAELAGEKYTALAESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRNKEDFFRFPTAIGDNDLYSKEDQPKIEAIKSKLAKLYEENGAVFREIKQARLAGDFGRLQQLKASVFPARKRIAELYRALDKLKQPRNVRAVREWFRAQLEGASPAPNGPVLPRTMAWQRTPTEATLYRRVYLIYKDCPERSLLALTDLAFAPNPRNPQQPVFDLKWLRTRIQSIAEHPGYDRKKLQSVLSAKLEATLSAKRFASCQFGPEDWQQICAQPEVAACFQPVGRGKSKRPPEPDQRLVKVCKVEVLPATRYELSELGYTSGNNYVWNPDHLAETARNILRKDDAQARTRGRRRTPAPASSPSADASPWPGFLWDREMQAKLASPEFREALEQQLVPHLLPPKPARMSDAERTDWATREERWKQAFEQFRKSHNLPKSFFVFTSDSDRPPRRPNVSLLRVLFEPKDKVFSRDALAKQAQSVVDAQLRRCLECFADSLTQVRDPRLQEKAWRDYCNVVRVVPKETLEQFTREHPTPTADQWISFFEAQTGPRIFQVMQTVGTSLEEYFDLSKDACGAFARGGNKGYWLCKRGDAIEARPIRFFENPEQVRVRLLGQGWELLDPKPWRTGDLLNLPEAAQSGARSVPAGYYFLGSFSNDTGVNLKPCFGGEVPQNVSLKALWNRGLRRCSPTA

SEQ ID NO: 65 - protein, 983 aa, Unknown
  Description of Unknown: uncultivated organism with predicted taxonomy: Elusimicrobia bacterium HGW-Elusimicrobia-1
  MG1-68 effector
MGKIYAFDLGTGSLGSCVREDKEIKDLSVELLPNDFATLKEARERRRQIRTRIAHKKREEWWKEQSQKAGIEVLETGHLDKNGNFIKPDDKISRQFPESGDDAIYNSSLLRIAILQGKKLEGWQIFKAIWSAIQHRGYDSNLPWIRESKRNIDEDENTEQINKDEKENQEAVKKYNNALKDVFGDKKEYYYPCYYEAYKMGIWSPNEPNNLNKKFSANPNPARNKDGKVDLVIPRDLIEKEIKDMLLKIGESYPYIKENLDLILYGPGKSKYAAYKAKEYRKYLGKDWEWQGLLSQKTPRFDNRLISKCALIPRLNVCKAKDELNKEVVFLMKLKDVRYYKIDGGEEKYLTNEEIKNIYEKFKDKLKITERQWTKYLKENLQGSPNPSQPKIEPSKPSGRSRFCRPALRIIKEIILSGKSPDLLYKELVENNKNTDPKKGLVKEDYSFLLKMPEKWENFHIPDNRMDESKLDETERKNLIEEIFSKTSNPIVKHRLKIFYDKLIEYKNKFGEPEKVIIEFVRDTDDGFYGKIKKKKIIAEQNKNRKESDLAFKEAQTLGLKGGESILKIKLYREQGGFDLYDGKTIKDTEIDNYEIDHIVPREDGGPDSYINKVLTSRKNNDDKGKRTPYEWLSKSDNWEEYFERVKKLPKDSKKKKDLLVSANAKELVEKYTQLAETAYIAKLSQKICHLFFGWEQGTEGSKRKVIVANGGLTAKMRNAYDLNRILHTGLSDAEYKELCKSGEIDKKNRDNPRHHALDAMVISMIPEIKMNDRKKDFFPIWFNPDYCREKLEQCFPKNIRYEKPKLAETIYGLREIIDDKGNKKYVFVSRLVGDVKNIEGYYDIKTAKKYLDKIFSDKIRKDFKEKLDSNPSNEEWKSFLDNYFAGGKPKKILLKVSDEYTYDKIKDFLDGKVKNCGEFIKGRLPGQYLKQKKEAYGYFIYKNEKEKWIRDVIYAFDSVFNKMKEIKSKYKEAYFFRSEMLV

SEQ ID NO: 66 - protein, 1235 aa, Unknown
  Description of Unknown: uncultivated organism with predicted taxonomy: Pedosphaera sp. Tous-C6FEB
  MG1-69 effector
RAMTSPATIWAFDLGKGSLGEAVLNLETHQFHHKATLLLPADLAQRGPASQAGTPASRYRALKVRQAHRERERWLDTVWQAAGLEVLQPRQTALVCALPPKRDDTGQPLFDQGHWALVGRADYRLEREFAPALGEKTKDGAPSDAAGANLCYTSCLLRIKLLRWKPGDPALEDWQVYKALRSAMQKRGYGPVPWAAEESRPKLTKEEQAKEQEIAARWDKFKKGYRYDENPDADPNRAPLPPQFHFPCYYDAFHMGLWRPDQPDHLRPRPDHRAASTRNVRFDRADVRKELIALGNNAAAMLPQLQQAFERWQSDGWTFRHPVTGEELTKPVRARTFGEFLCDGPAGQPDETSFEAFLNQRRQAGIRIGTFEEWMAALGQKTPRFDNRILAPCVLIPRYHACKVDARLEKDRAGRLTGKLVPDSLLASEVTFLLKLKNLLVADPVKGQRKLTVEEVREIFAFAQRRLKTLPLLTPEGEPAKEWPRKVANCFAINPSDWPKIAAEAECLKGLARLTVSDNGAPRPLTREEAEALLHAVAGGRRAAQTVLPAHLLPLVKRAAAAWKQAKQQAEEIMLRPLPGHEEVKAPRTCGRSAYSRVALRILKELILSGDAPSAFHARLVRREPDLLQRLGPAPGQPLAIFDDSTASNEAQRKQENAENRKHGLLVSELNFLLQMRKDDGSPDSWENLFIPAQTLEALQQRHTEDGRLDADAAVRELLGTIKDPVVRHRLGVFDERLRKLRFGDAREGLPGFGVPEAIVLEFVREDFMGEEAKRRLQTFQRQREEERKKARSIAAQAGAESALSALKCQLWEAQGGECLNGREVLDQTGQSKARCLYRQTALPLSRLDEYVIDHIVPRARGGPEAMVNYVLTTAETNEAKGDRTPFEWLHGSPDWDAYVARVKARAAALRNKKVQLLTREDAPELVERYTALAETAWISKLAQTIVNLRFGWRNGVDYSGPQPVKRVIVVSGGLTARVRRKYGLDKLLYGEDTAPEVLAKKVKNRDDDRHHALDAMVMTFIPHWARDPNKQGFFRFPPAFRDANGREDYQRIRSLFASHLQQIVPRHLAYEPSVLADTIYGGRLDNGRPVIVQRVPVRELAYKQEQQRPVFNLTYARDQIAHVRDPRLRRVLEAFVATGPDQAAWDNYCRALAAGTCPELPDRKVLKVTLNRDEDPEEFKDLSKDGCGAFRTRKGEHRGQFVYLDARGRVRVRPVRPFESLVAVKAEVERLAAG

SEQ ID NO: 67 - protein, 1052 aa, Unknown
  Description of Unknown: uncultivated organism with predicted taxonomy: Endomicrobium
  MG1-70 effector
SIAYCVREGVNVLDIGVDILPGDFASLKNVREKRRMIRTRMAHKVREEWWKMHAKEAGIEVLETGHLNENGEFVKPDIRLSTEFTPPGDSTIYNSYLLRIALLQGKDLESWQIFKAIWSAIQHRGYEKAPWVRKEEAQKEPSDGKKSRKSKSEDESEKEREEKEIQQAVENYRNELKQAFGDNHQYYYPCYLEAYKLGIWSPDEPDNLTKTISENPEPIRNKDGEIRRIIPRELLEKEIKELLQQAGKKYPYIEKNLNYILYGPAGTKYPAYTLKEYRRYMGKDWEWQGLLSQKTPRFDNRIISKCRLIPRLNVCRRKDELVQDVTFLMKLKNFRFIDRETGEVKALTPEQLKEMFETFRSERKINKTELKKYVKDRLNGWVHPSHTNIDPPKTTGRASYCRPALRILKEILLTGKSPHQLYQEYTSTNTNTDPRKGLVNDDYKFLLDLPAEWDNFYIPDRREEEANLDEETRLKKIYETFSKITNSVVRHRLLLFYNKLRELKEKYGAPDKVIFEFARDPEETLETSKRKDYKKIQKFNLKAKEKAKQILEELRSKGISMQGSNKVLKVRLWQEQGGFDVYTGQPIGETEIDICEIDHIVPREMGGPNARYNMVLTKPECNREKGKRTPYQWLGQDPEEWQKFVERLEREKGFENLPAKKKNLLVATNPEELIERYTHLAETSYISRLAQRIVHLFFGWEQLTKGSTRHVYVVSGALTKYIRDKFELDVLLYPDLTKEEVFKIPSEEREEKNRNNPRHHALDALVVSIARPENVDKYPEWFTQDFCRMAIEKCLPVKVRFEKPTLAETIYGLRPMLDDNGRPTGKYVFVTRFGEGTRFSDYSKLEHAKKNVDSIYSANIRRDLKNKLKENPSKEEWEVFIHNYRAGGKPKKLLMIASSEIDGDDVKKFLSGELRNLGEFIKGKMPGQFLKQAQESRGYFVYKDEKGKWRREVIYAFESPYLRRREILSKLKDCKEIYFFRSGMLVKIENDFLYEPRGGASKTIPGGYYYINTINVSEQVKITAIDGREIKLSLSQLMEKGRMKPAQKVRMD

SEQ ID NO: 68 - protein, 1110 aa, Unknown
  Description of Unknown: uncultivated organism
  MG1-71 effector
WQIYKALRAALQNRGQQTVPWIAREAARTGKTPEELLEEEKKAFENKDPDYQSALTKWQQFCQLDPIKNNHSLQYPCYYDAYKIGLWDPTQPNSFKNKPDHNAASTQQVVFPGDRIEAELLLLAQNAATQLPVLDHAYKKVIGEFLNDRRARIENINQKRAARAQARNQAPRLLSTENLPHAKNFAELFVYGPAGKPNLPNGYRNIALADASIARALVLRPGTDFDHQSAIGQKIPRFDNRILAHCALFPRFHVCKATPKIYPDNSVDADSLLPCEVTFLFKLKNLRVSRAGQVTSLTPQQIQTIFHHVRNTALSQLGAAQEPSAKALASKFSLTKTELTKWGKKPGMAFSLLPTQQEIEKPKFLGRSRFSKPALKIIKEIILSGKSPQQIAQELKAPNSPLAQQLQLKISPQSPMQGLTHHDLDILTKCGDSWDNFHIPDTTTDFLLSTNQNSSYPNQSDKDTLIKKYIATSNNPIIRHRLELFYERLRLHLEKYGKPDFIALEFVREDFLGEEAKKKIQKIQNENKKLNSQAAEKVEELKLAGRQSILKYKLWQLQGGICLYTGKPIAQTEIESHEVEHIVPRNHPQTQGPDAQWNLVLTAREINDRKANRTPFEWFQQDPIAFQWPMGQPDASIPSQEKQRLWEAYCDRIKQRKKNLGNKRVKLLLSDKAPELVERYETLATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEKARLAETAYGFRIINNKKKIAQRVAVEKLAYPGQEQKFDLAYLEGQIPSIADEKIRSMLTEIYNNIKSKTLQEAEQTWKDECAKLRLKTRDGSPGPFIKKVTQITDFHREYKDLSKDGTGAYYKGGDRHQGQFIYRDARGEFTVHPVYVHESIPQVKKALIEQNKTICIFVNSGCLVKTAQPIDPANYRKIIYENNKPKRITPEHPLPSGIYKWRTIIESSTSVTLENVFGEEFAINFCHLCKAGIQRL

SEQ ID NO: 69 - protein, 1005 aa, Unknown
  Description of Unknown: uncultivated organism with predicted taxonomy: Deltaproteobacteria
  MG1-72 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVNQARAQGKTPEELEAEEQKQLEQADPRYREAAGKWPEFKRAVPAEFHFPCYYDAFHMGLWSPDQPDQLRLRPDHRAASTRNVRFDRADVRKELIALGNNAAAMLPQLQQAFERWQRDGWTFRHPVTGKALTKPVHARTFGEFLCDGPAGQPDETSFEAFLNQRREAGIRIGTFEEWMAALGQKTPRFDNRILAPCVLIPRYHACKVDARLEKDRAGRLTGKLVPDSLLASEVTFLLKLKNLLVADPVKGQRKLTVQEVRDIFAFAQRRLKTLPLFTPEGEPAKEWPRKVANCFAINPSDWPKIAVETECLKGLARLTVSDNGAPRPLTREEAEALLHAVAGGRRAAQTALPAHLLPLVKRAAAAWKQAKQQAEEIMLRPLPGHEEVKAPRTSGRSAYSRVALRILKELILSGDAPSAFHARLVRRDPDLLQRLGPAPGQPLAIFDDSTASNEAQRKQHDAENRKRGLLVSELNFLLQMRKDDGSPDSWENLFIPAQTLEALQQRHTEDGRLDADAAVRELLGTIKDPVVRHRLGVFDERLRKLRFGDAREGLPGFGVPEAIVLEFVREDFMGEQAKRELQTFQKRREQARAEAEAEAAKLGLESRSSSLRYELFKAQGGICLYTGRTLSETQLDQYEIDHIVPRSLGGPDAMVNYVLTFPEVNSAKEKGKLTPYALLHGTDGWDAYVARVKARAAALRNKKVQLLTREDAPQLVERYTALAETAWISKLAQTIVNLRFGWRNGVDYSGPQPVKRVIVVSGGLTARVRAKYGLDKLLYGENTPPEVLAKKVKNRDDDRHHALDAMVMTFIPHWARDPHKEGFFRFP

SEQ ID NO: 70 - protein, 1141 aa, Unknown
  Description of Unknown: uncultivated organism with predicted taxonomy: Pedosphaera sp. Tous-C6FEB
  MG1-73 effector
SLTTLVTFPIVSPMPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVNQARAQGKTPEELEAEEQKQLEQADPRYREAAGKWPEFKRAVPAEFHFPCYYDAFHMGLWSPDQPDQLRLRPDHRAASTRNVRFDRADVRKELIALGNNAAAMLPQLQQAFARWQRDGWTFRHPVTREALTKPVRARTFGEFLCDGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAALAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSDLLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAHLGRRKVDLLLRPDAAELAGEKYTALAESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSQLAKLYVENKPVFREIKQARLAGDFGRLQQLKASVFPARKRIAELYRALDKLKQPRNVRAVREWFRAQLEGASPAPNGP

SEQ ID NO: 71 - protein, 1171 aa, Unknown
  Description of Unknown: uncultivated organism
  MG1-74 effector
WIPKLCQKADYRLEREFPPSRILPSGKAKDGAPAATEADLAICYNSALLRIKLLRGEKLEEWQIFKALRAALQNRGQQIVPWIAREAARTGKTPEELLEEEKKALKDKDPDDQSPMTKWQEFCQLDPIKNNHSLQYPCYYDAYKIGLWDPTQPNSFKNKPDHNAASTQQVVFPGDRIEAELLLLAQNAATQLPVLDHAYKKVIGEFLNDRRARIENINQKRAARAQARNQAPRLLSTENLPHAKNFAELFVYGPAGKPNLPNGYRNIALADASIARALVLRPGTDFDHQSAIGQKIPRFDNRILAHCALFPRFHVCKATPRIYPDNSVDADSLLPCEVTFLFKLKNLRVSRAGQVTSLTPQQIQTIFHHVRNTALSQLGAAQEPSAKALASKFSLTKTELTKWGKKPGMAFSLLPTQQEIEKPKFLGRSRFSKPALKIIKEIILSGKSPQQIAQELKAPNSPLAQQLQLKISPQSPMQGLTHHDLDILTKCGDSWDNFHIPDTTTDFLLSTNQNSSYPNQSDKDTLIKKYIATSNNPIIRHRLELFYERLRLHLEKYGKPDFIALEFVREDFLGEEAKKKIQKIQNENKKLNSQAAEKVEELKLAGRQSILKYKLWQLQGGICLYTGKPIAQTEIESHEVEHIVPRNHPQTQGPDAQWNLVLTAREINDRKANRTPFEWFQQDPIAFQWPMGQPDASIPSQEKQRLWEAYCDRIKQRKKNLGNKRVKLLLSDKAPELVERYETLATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEKARLADTAYGFRIINNKKKIAQRVAVEKLAYPGQEQKFDLAYLEGQIPSIADEKIRSMLTEIYNNIKSKTLQEAEQTWKDECAKLRLKTRDGSPGPFIKKVTQITDFHREYKDLSKDGTGAYYKGGDRHQGQFIYRDARGEFTVHPVYVHESIPQVKKALIEQNKTICIFVNSGCLVKTAQPIDPANYRKIIYENNKPKRITPEHPLPSGIYKWRTIIESSTSVTLENVFGEEFAINFCHLCKAGIQRL

SEQ ID NO: 72 - protein, 800 aa, Unknown
  Description of Unknown: uncultivated organism
  MG1-75 effector
MTESDPFQHKAILRKWENHEFYRSSVVLGLDVGLEGIGVYLRKGPRTLYEKTLLYQIPKTNALQDRRQSRAARRCRKNRRTRMTRLKALFERHGFPWFEGNDDALTRSDPFLLRHRATTKKLASREALGICIRHLVTHRRYEFFSDEGENPWGEEASLATEVKWLRTAYVDEKDADLLRTECRVLADVAGGRAEDKYEEFRQILEDRIVTERNNPILEMLESYAGEKRNHLRQKARGAVFPRRLVWSHLESICRRHGELFDDVDEFLRDLGAPRSRKDRAIFNYHRKTEEEMKAHWARKVGPCPYAEMLGLSSKLRRGVRGEMPIRRFSLLEFLVSRRIELSDGRLLLVPDSCIEMLFDWMERFEAAYRDQRTLPPMKKIREIVVGEMRKSTGQAPAPASKSEINKAFFEQIKGIMAPTASRRNARASLSCEAAEKLFEEATSSGLSRDSVNRQLQTYYQWRKRASSDFGLYPQVEFLLGRRRRRRAGEGEYAVSGRLQRIFSLPEVVEHLDGQASPDYCVIEVVGDIPRNEKERREKEQEIRKNQGRKEKLFERFNAADSAVGSAYKRVLLFDQQRGLCPYSGGELGDPLSSDLEIDHIFPRKRGGISVRENLVLTFADRNRDKGNLTPREAARKRNGWDWDEIEAATARMKWSRKKREIFEREGAGIPPLANVTRTAQLARQLVAECAHWMGIAGDPDEIQRRIGTPSGYMRAQALRSWEDTVPAKNRSDLVHHLVDAAVVAHIPPGAGMNQVSYGGIFYPSSVDGKDRARLAALPLGPGLRRWTAAEPLECSAAPPG

SEQ ID NO: 73 - protein, 953 aa, Unknown
  Description of Unknown: uncultivated organism
  MG1-76 effector
MGNGTIFSFDLGTGSIATCVRQDEEIKYIHVETLPGEFATLKETRERRRQIRTRLAHKQREEWWKIHAKEAGIEVLETGHLDEKGNFISPDPRLTCEFSKKGNPTIYNSLLLRIALLQGKKLEGWQIFKAIWNAIQRRGYDENIPWKHKLEAEKTEDDNEQENSKQTKGKKSKKKEDANSEDEEQKIRQAVIKYKEKLNNTFGDKEEYKYPSYLEAYLLGIWSPDEPDNLTKTISENPEPIRNKDGNIKLITPTELVEKELKQLLVKVGEQNEYIKKNLNYILYGPSGCRYGTYILPKYRRYIGKDREWEGLLSQKTPRFDNRIVYKCRLMPRFNVCKRKDLLSQEVIFLMKLKNFRFVDAETGEEKMLTPEQIQKMFNDFQNTLKINNRELKKYLKENFKGEIHPSFPAIDAPNTKGRASFCRPTLKIIKEIILSGKSPHTLYQEYTSSNTNTDPKKGLINNDYKFLLKMPTEWENFHIPDEREDEAQLNEDERIKVIYNILSKITNPVVRHRLLLFYRKLQYLKQEFGIPNIVMLEFARDPEELLAGEERKKKYLKLQKENRQKKEKAEKIYQELKNGNVNLKGRSILLKIQLWQEQNGIDPYSGEQIPQTKINLYEIDHIVPREMGGSDAYFNKVLTSPEKNREKAKRTPYQMFKGNISDWKKYLNTIEKITNLSKKKRALLTSENPEELIERYTHLAETAYISRLAQKICHLFFGWEQLTKGSQRKVFVVSGAFTRKIRTIFELDRILYPDLSDEEYKELLTKGEIQKKNRDNPRHHVLDTIVLSIIPEIKYNPEREKDDYPVWFNKEYCRQYIEKCFPRPIRFVKAKLAETIYGLRERNDYTEEEKKKGKKQYVFVTRFGTGTTLKELKEYDDLKFAKKNVESIYSYNIRQDLMKKLEEKPAPEEWKVFLHNYRAGGKPKKILVKASSYIDEEEVQKFLNGEIPNLGE

SEQ ID NO: 74 - protein, 898 aa, Unknown
  Description of Unknown: uncultivated organism
  MG1-77 effector
MTTPATIWAFDLGKGSLGEAVRDQQTNQFLHKATLLLPADLAQRGPATQAGTPASRYRALKVRQAHRERERWLDTVWQAAGLEVLQPRQTALVCELPPKRDDTGQPLFDQGHWALVGRADYRLEREFAPALGEKTRDGAPSDAAGANLCYTSCLLRIKLLRWKPGDPPLEEWQVYKALRSALQKRGYGRVPWAVKEARARGKTPEELEAEEQKQLEQADPRYREAAGKWPEFKRAVPVEFHFPCYYDAFHMGLWSPDQPDHLRLRPDHRAASTRNVRFDRADVRKELIALGNHAAAMLPQLQQAFERWQRDGWKFPHPVTGQELTKPVRARSFGEFLCDGPAGQPDETSFEAFLNQRREAGIRIGTFEEWMAALGQKTPKFDNRILAPCVLIPRYHACKVDARLEKDRAGRLTGRLVSDSLLASEVTLLLKLKNLLVADADTGQRKLTVEEVRDIFAFVQRRLKLLPLLTPEGEPVKEWPRKVADCFAINPSDWPKLAAETECLKGLARLTVSDNGAPRPLTREETEVLLHAVAGGRRAAQTALPAHLLPLVKKAEAAWKQAKQAVEGNILRPLPGHEEVKAPRTSGRSAYSRVALRILKELILSGDAPSAFHARLVQREPDLLQRLGPAPDQPLAIFDDSTASNETQRKQEDAENRKRGLLVSELNFLLQMRKDDGSPDSWENLFIPAQTIEALQQRHTEDGWLDADAAVRELLGTIKDPVVRHRLGVFDERLRKLRFGDARERLSGFGVPEAIVLEFVREDFMGEQAKRDLQSFQKRREQARAEAEAEAAKLGLGSRSRALRYELFKAQGGICLYTGRPLSETQLDQYEIDHIVPRSLGGPDAMVNYVLTFPEVNSAKEKGKLTPYALLHGTPHWDAYVARVKARAATLRNKKVQL

SEQ ID NO: 75 - protein, 1035 aa, Unknown
  Description of Unknown: uncultivated organism with predicted taxonomy: Verrucomicrobia
  MG1-78 effector
MSKTETVWAFDLGKGSMGEAVRQGNQFLHKASLLIPAEFAETRTARDRRRMWRTRQAHKARERWLDEVMTAAGIEVLKGRQVGKVDGKWVETAKGDPRLEREFAAPGDSTCYTSCLLRIKLLRGEKLEPWQIYKALHSAIQRRGYDPDIPWKTREQRQGKKSEDEEGKTLTRMQEFEKQLLAMSPDHPEYRWPCYFDAWKMGLWSPAKPDELKERLDFNAQTTRDQIVPRKVVEAEVRALVEAASQFYPSLKGKADYLLYGPPQRAYASYYVEQRKQHGLREGGVNDWQGVVGQKIPRFDNRIIGKCVLIPRLNVCKIRKGDDGKLHPQSRIVAETVFLMKLKNMRLQTAKGVTGLTAQQISKIFADPKRKKYGLTKTQWKQWCIKFGGMPLPGNQEEVEEPHFGGRSRFCRPALEIVKRLILSGDTPPMAYEKEVARLNGNTDPLKGLVKDDLKFLLQMGPTWEGIYIPNQKLDALTRSTEDANEAIRQLIGAQNDPIVRHRLTLFADRLNLLAEKHGTPDCVVLEFVREDFMGRKAKQEYLKFQRERAKERSEAREEAAKAGATEGAAGLKMELYKAQGGICLYTGEALSVTSLDEYVIDHIVPRAKGGPDSVMNYVLTTRRANDDKLDRTPYEWLSQTPGWDAYVERVKERAVTLRNKKVSLLTRPDADTLVDKYTALAETAWISKLAQTIISLRFGWPGGIANGERKIIVVSGGLTGRIRRKYKLNSLLNPDAKSEEEAEVKNRNDDRHHALDAMVISFIPNWARDAKKTGFFRFPDGIHRELFAKEIADVIPLNVCFEKPALAETIYGARNDHGAKVIVQRTALLSLAMKPTTPGKTTFDLKYAGKQAQSVRDPIIQKRLLEFIATNPDEATWRKFCAELHIKRKDGTAGPRVEYVTVTVGEPTEYKDMSKDGTGAYRKALKGHKGQFVFVDSKGKFKVRPVYAFESAQKVGQELTQKFGQNAIKGFFQSGCLVELTAPVPHSFTPLVPGQYKLNTIFTDGRAKLTDSTGKQSLPISLEKLFSAGFKRAR

SEQ ID NO: 76 - protein, 1333 aa, Unknown
  Description of Unknown: uncultivated organism
  MG1-79 effector
MPTTNPYVITHVTKNWMKDEFYDSALVLGLDIGIEGIGVWLRKGREPLFARTFMVSLPEAAPLKNRRAKRAQRHARQSLRRREAMLREWVVRYGLLPQEKTDGRWWKNPAVFERAFEHRHRAITTGVASPECLVVCIRHLLRHRGFDYHLTDEGAFPWGDELDDKEIIQWAKNSCCAPEYRTHLCNLIEADAAWAKNSDGSFTEKYLKVRQALDDAVREYENRPVERMLEQHMSEKNHPHLRPRARGRNFARELVKQHLYAICEKHRHFFAPGTFDQAMRELLGDQTGPSQWKLTWMDQDGKARQTILDYHRRTREEAEELWKRKVKKCPFAPLLFEKRHPTTPQHDCAVRSDPRIRRFNLLMFLAERRIELETHDAEGRLQNPRVNLDANVVRDLLGDLEQDIRAVEALRNKQSASRPDKPGKKTFEQRWRICNDCGKETGQDETGKSSCCKAKTKPKMPLAGVAKGSFNADFFDQLGDLLRPELRSLKGRASLSGEAAEVLFKLVTRNGTDFEPARIRQALEDCGYYDWRTNLPAGLGIYPQVTFLLGNRGHYDKDGNPRQIDKTTGNPVHHGILRRLFAGQLRLDDGTLVGLKDKLDDKVVPDYVVIETIGEIPKNQKEKKEFQDEIKANRSRKTDIIEKKYGLKLDSLSDWQVKQVLLFDQQANEEGEAFSPYSGVSLGTNPLAHDLEVEHIYPERRGGISVMDNLVITWRTENQTKGDRTPWEWAKDEGWRVDVHLQKMHWSANKRALFVRQESDPPQWDNTTRMAQLARHLRAEVIHWLGLDQIQDQKERNKEIARRIGTPTGFQTSVCRESWTPPHVFPQMYRLLCDKKGVPVRDRNGQERWVKDRTNLRHHLWDAAVLSHIPPGVGLNSADCGGIFVHRRDPQNGEWSVSALADLGPDLVAFEKANADRCLVVRLRQRKSKKSRYKETIFSLPDQQNRVFAREPLSKVVTSLLKSKKKNPDAELRKLLDRPGLLNPLEITNKKTGQTKQIKLLNKADVERWLSCKDVSLDQEGFRKFIEDVGVPTEQIPDDAVKAAFMKRNGETLLRKTFKPNSLVSFIRQKCRIKDSEIEARVEIAIAERNERTVLRAANGRDGQPGQVIRSILIEQDKLPPCGFGLHFNPTAKPKRGSEVAGFKPVDNSNSVVYLRREIWIGQRTKKKGRKTTVETFYKSRLIPHPRHLASYQKLHGQPWKADPLPLGMKLAGKLAVGDLLRIPLKKEKRNRNDNLIAKRGETPLESRFYRVKSMKTNCTIEFQMAEFAEPKLVKGQIPDPATERLLETYELTCSNEADLLWLLEVTTGKRIKLPPPVVENAPTTGKREGELL

SEQ ID NO: 77 - protein, 1035 aa, Unknown
  Description of Unknown: uncultivated organism with predicted taxonomy: Verrucomicrobia
  MG1-80 effector
MSKTETVWAFDLGKGSMGEAVRQGNQFLHKASLLIPAEFAETRTARDRRRMWRTRQAHKARERWLDEVMTAAGIEVLKGRQVGKVDGKWVETAKGDPRLEREFAAPGDSTCYTSCLLRIKLLRGEKLEPWQIYKALHSAIQRRGYDPDIPWKTREQRQGKKSEDEEGKTLTRMQEFEKQLLAMSPDHPEYRWPCYFDAWKMGLWSPAKPDELKERLDFNAQTTRDQIVPRKVVEAEVRALVEAASQFYPSLKGKADYLLYGPPQRAYASYYVEQRKQHGLREGGVNDWQGVVGQKIPRFDNRIIGKCVLIPRLNVCKIRKGDDGKLHPQSRIVAETVFLMKLKNMRLQTAKGVTGLTAQQISKIFADPKRKKYGLTKTQWKQWCIKFGGMPLPGNQEEVEEPHFGGRSRFCRPALEIVKRLILSGDTPPMAYEKEVARLNGNTDPLKGLVKDDLKFLLQMGPTWEGIYIPNQKLDALTRSTEDANEAIRQLIGAQNDPIVRHRLTLFADRLNLLAEKHGTPDCVVLEFVREDFMGRKAKQEYLKFQRERAKERSEAREEAAKAGATEGAAGLKMELYKAQGGICLYTGEALSVTSLDEYVIDHIVPRAKGGPDSVMNYVLTTRRANDDKLDRMPYEWLSQTPGWDAYVERVKERAVTLRNKKVSLLTRPDADTLVDKYTALAETAWISKLAQTIISLRFGWPGGIANGERKIIVVSGGLTGRIRRKYKLNSLLNPDAKSEEEAEVKNRNDDRHHALDAMVISFIPNWARDAKKTGFFRFPDGIHRELFAKEIADVIPLNVCFEKPALAETIYGARNDHGAKVIVQRTALLSLAMKPTTPGKTTFDLKYAGKQAQSVRDPIIQKRLLEFIATNPDEATWRKFCAELHIKRKDGTAGPRVEYVTVTVGEPTEYKDMSKDGTGAYRKALKGHKGQFVFVDSKGKFKVRPVYAFESAQKVGQELTQKFGQNAIKGFFQSGCLVELTAPVPHSFTPLVPGQYKLNTIFTDGRAKLTDSTGKQSLPISLEKLFSAGFKRAR

SEQ ID NO: 78 - protein, 1074 aa, Unknown
  Description of Unknown: uncultivated organism
  MG1-81 effector
MNSSRSPVTRFSTGLVFGFDVGTGSIGWAVRNGTEFLDVGVLVCPEETAKLDSRRGLRRQRRTLRSKKYRRQWFARELAGLLGLTLIRQGQSELPLPETAWEQNAKGGWVPKPGFESLRDPVALRVAAAEGEPLRPEELFTALVHLFRLRGYLADVPWANREVEAKESDAKKEEGEIRARMSALQAEMQAAGCELPCQLLALRANNGQRQRKEVWPRELVEKEFRAIVAAQATRHPTLAEKADWLLFGDCREVKSHRVFFKTTESRNPGVLGLKWPRFDNRGPALDALRPIDELGRPLHVVRKNKEAFSKAQWELAVMNFRVIDRQTGALVPPDARALARLREMWESSSRKRRAKKEAMSGTPAGSPETTPRVEIKVALLEKWAAEFANRYKLVEGQQSLTPQTGAGRARYSTPTLELIREQFERGIRFDPPQPVLRRPGESPQRALDRYLADIKHPLVRHRLLLFSRLLDKLVKQHGEPDLIVLEAVRSLALGEKNKRELLKRNKANRDQRESIRQELASRNASTSRNAILRYRLWKEALSTCPFCGDKITQEQLLRGEADIEHLVPRSVVDCNEFYNLTVGHVRCNRELKGDRTPFQAFGHTEKWPQLRDNAEKCFKGRKLEIFLSDNAEQLIEQKADLQHTAYIARIVRHVALIRLGWTGDDGRDPTIIKGNKPSSSFQVTNGQLTSRLRQAWGLNHILHPLPEGKRWDDLTDAEKEQMQQKNRGDLRHHALDAMVIACTLPWLAHRTVGATDPETGEHGWWQLDERTRRSLALNPVFPTEGQMRRVAEEWMQKVVVRHHVSRSPHQSAYATTIYGKKAPNTYVAREVFTTLTPKNLGSIWPPDFAAYCEAAWARYVEESPDIEAELKRSKGCVPESFTARLCFAHFQQWRELMKRGENVEFTWPETVKIPIRSVRLISVKDDTAVMRFAPGTPGYVKRTGFKEVRIHVSADGNSFVPVFVPYWKGDAIPPETPIKTGTRPVAVIRKGQVVGLKKPLAAGASAGHYRVIVLGQSQVSILPPHVANKDEAKLALGIPRTGIKPYWPEFIRALGYELPHPPSAQSPPPGALPT

SEQ ID NO: 79 - protein, 917 aa, Unknown
  Description of Unknown: uncultivated organism
  MG1-82 effector
MTPATTIWAFDLGKGSLGEAVRDLQTDQFLHTTTLLLPADLAQRGPARQAGTPASRYRAWKVRHAHRERERWLATVWRATGLTPLQTREVWQNPSTGRWELKHPADYRLEREFAPTLGEKTRDGAPSDEAGANLCYTSCLLRIKLLRWKPGDPPLEKWQVYKALRSAMQKRGYGRVPWAVKEARARGKTPEELEAEEQKQLEQADPRYREAAGKWPDFKRAVPAEFHFPCYYDALYMGLWSPDQPGHLRLRPDHRAASTRNVRFDRADVRKELIALGNNAAAMLPQLQQAFERWQHDGWKFLHPVTGQEVTYPVRARTFGEFLCDGPAGQPDETSFEAFLNQRREGGIRIGTFEEWMAALGQKTPKFDNRILAPCVLIPRYHACKVDARLEKDRAGRLTGKLVPDSLLASEVTLLLKLKNLLVADADKGQRKLTVEEIRDIFAFAQRRLRTLPLLNPKGEPVKEWPKKVANCFAITPSDWPKLAAETECLKGLARLTVSDNGTSRPLTSEEAEALLHAVAGGRRAAQTALPAHLLPLLKRAADTWRQAKQAAEGNVLRPLPGHEEVNAPRTSGRSAYSRVALRILKELILSGDAPSAFHARLVRREPVLLQRLGPAPDKPLAIFDDSTASNEAQRKQADAENRKRGLLVSELSFLRQMRKDDGSPDSWENLFIPAQTLEALQQRHTENGRLDADAAVRELLGTIKDPVVRHRLGVFDERLRKLRFGDAREGLPGFGVPEAIVLEFVREDFMGEEAKRRLRSFQRQREAERKRAREETAEAGATEKSAPLKYELLTAQGGLCLYCGQALTLKKLEQYAIDHIVPVGAQGSDALFNKVLAHQECNAAKGKQTPFEWLHGTPGWDAYVARVKARAATLRNKKVQLLTREDAPELVERYTALAETAWISKLAQTIVNLRFG

SEQ ID NO: 80 - protein, 1016 aa, Unknown
  Description of Unknown: uncultivated organism
  MG1-83 effector
DSAGKPQQTILDYHRKTPEEAKELWERKVKDCPFAPTLHQQDKLSTPKHKCSFRSDARIRRFNLLMFLAERRVELETEDAQGQRQNPCVNLDAEVVRQLMEDLEKDIHAVEALVNKQPAPRPDKPGKKNFEKRFNLSLAGVAKGSFNADFFDQLGDLLRPELRSLRQRASLSGEAAEVLYQLATNNGTTFEPVKVRQALEECDYYHWRANPPHGLGIYPQVAFLLGQRGHYDDEGNPTDKDKAGNPVHHGILRRLFAGQLRLDDGTGQGAKLIDLCEHLDGKTVPDYVIIETIGDIPRNQKEKKEFKDEIKANRSRKTDIIEKKYNLKLDSLSDWQVKQVLLFDQQANDDGEAFSPYTGASLGKNPLAHGLEVEHIYPERRGGISIMDNLVITWRTENQTKGDQTPWEWLGQRATAQLQKMHWNRDKRALFVREESEPPQWDNTTRMAQIARYLRVEIIHWLGLDRIKNEMERNKQIAGRIGTPTGFQTSICRESWTPRTVFPQMYRLLHDKKGIPVRDQHGRERWVKDRTNLRHHLWDAAVLSHIPPREGLNSADCGGIFVHRRDQQTGEWRVSALPNLGPDLVAFEKENEGRCLVAHLRQRKSKRSRYKDTIFGLPDREQKHFAREPLDKVVAGLLKSKKKNPDVQLRKLLDRPGFLKPLEIKNKKTGEMKRIQLLREEDLTRWLSCKDISLDPQEFRDFIAKLGVPAECVTDEAVAEQFLNSKTGESRPKWNFKPTQIIAFIRKCGVKEDKLPNSRVEDAIRARKECTVLRASNGRDGQQGQAIRRIPIEQDKLPPCGFGLHFNPTAEAKHGNAIAGFKAVDNSNSIVYLRREIWIGQKWKKKGKDKVASTFYESRLIPHPRHLAAYEKLHGQPWKSEPLPAGMSLAGCLAVGDLLRVPLKKEKKNAGDNLIAKRGEPPVEWKFYRVKSLRTEGPVEFQLAEFTEPKLAKDQIPDAATKRLLDICELSSRKDADLLWLLEATTGQEVQPLPPCDEPPPVSPTKPATKTGDELL

SEQ ID NO: 81 - protein, 1062 aa, Unknown
  Description of Unknown: uncultivated organism with predicted taxonomy: Coraliomargarita sp. CAG:312
  MG1-84 effector
MNNNNTQIWGFDIGKASLGEAVWCGGEFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 82 - protein, 1080 aa, Unknown
  Description of Unknown: uncultivated organism with predicted taxonomy: unclassified Verrucomicrobia (miscellaneous)
  MG1-85 effector
YIVDFCSHCKYFNNNKKFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVDLSEL

SEQ ID NO: 83 - protein, 1062 aa, Unknown
  Description of Unknown: uncultivated organism with predicted taxonomy: Coraliomargarita sp. CAG:312
  MG1-86 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLQFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDMETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPVLEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 84 - protein, 1073 aa, Unknown
  Description of Unknown: uncultivated organism with predicted taxonomy: Verrucomicrobia
  MG1-87 effector
MYTKEIIWGFDIGKGSLGEAVRVGNEFKHVQSLEIAPDFAETKTTAAARRAWRTREAHKAREFWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELVKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVKKSALEQTIYALRKGRIVKKCNVRDLAYTGINPKYNYSTLVKSIKSIVGEVPKRIVSDFVLSNSDLSESEWEDWCKNNAAIPSKNGAPTKLLRVLCDAGNPEEYKDLSKDGCGAYRKGDSHKGQFIWKTKQGRYVVAPVYAHASKAKVLASLKNNPDCAEVCGFFRQNCLVEIPNDVVDKSGKMLLKSGIYKSNSIRADGYGYLENSDGISSKPISIQYLMPAGMKRIKLDII

SEQ ID NO: 85 - protein, 1059 aa, Unknown
  Description of Unknown: uncultivated organism with predicted taxonomy: unclassified Verrucomicrobia (miscellaneous)
  MG1-88 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSKTPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 86 - protein, 1059 aa, Unknown
  Description of Unknown: uncultivated organism with predicted taxonomy: unclassified Verrucomicrobia (miscellaneous)
  MG1-89 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCCNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 87 - protein, 1059 aa, Unknown
  Description of Unknown: uncultivated organism with predicted taxonomy: unclassified Verrucomicrobia (miscellaneous)
  MG1-90 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGIFNSHCTVDVGDVYNDKGDFILPAGRYMVNTIRSDNQCVLTNADGEKRNPININYLMRAGMRRVDLSEL

SEQ ID NO: 88 - protein, 874 aa, Unknown
  Description of Unknown: uncultivated organism
  MG1-91 effector
MVKRVARLRQTFWRDTENPDVVKIRIDNTAEKAKGYVVPRSAVIAEFRALVDAAAKQYPALKGKADFIMFGVSEEPYASYNPELRKKFGLKRGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFVPDVGVFDFADSTECSRAVQINKLIGMQNDPIVRHRLSFFYGRIKSLDAEFGTPDKIVLEFVRDDFLGKKAKADLSKAINDRAKEKKKYAEELDSQRENFGPKYASKKMLLKYELYSKQKGECIYTGRALGFSDLEQLEVEHIVPRSRGGPDALYNYVLTDEKTNKDKGDRTPFEWLSSKGVEWDAYRDRVRGLTKELGAKRCKLLLSPNAEELVEKYTALAETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEKPTLEQTIYAKRLINGKETIVKKCNVRDLAYAGRNPQYSYLTLVKNIKCIVGKVSKNIISDFVLSNPDLNESEWENWCKYDAVIPSKNGAPTKLLRVLCGARNPEEYKDLSKDGCGAYRKGNLHKGQFVWKTKQGCYVVTPVYAFESKIKVWDDMRRDPNCEEICGFFRQNCLVEIPNDVYDSKGVLKLKAGVYRSNTIRADGFVKLTNSDGFSPNPISIQYLMSAGMKRITLNTI

SEQ ID NO: 89 - protein, 1077 aa, Unknown
  Description of Unknown: uncultivated organism with predicted taxonomy: unclassified Verrucomicrobia (miscellaneous)
  MG1-92 effector
MSLYFIEQISDWKIMKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGLVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSYEGFLKRGEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 90 - protein, 1059 aa, Unknown
  Description of Unknown: uncultivated organism with predicted taxonomy: unclassified Verrucomicrobia (miscellaneous)
  MG1-93 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGREISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 91 - protein, 762 aa, Unknown
  Description of Unknown: uncultivated organism with predicted taxonomy: unclassified Verrucomicrobia (miscellaneous)
  MG1-94 effector
NRIIGKCKLIPRLNVCKIKPLKECKTEDDFLPHTITLALKLLNLRFFRGAGIDSLSFDEFLRAFEIARQNKFALNKTNLKKFFKTIGAEIMDENQSSVEQPREGGRASYSRPAMRLLRDLIFSGKSPAEFYASRICKIENTDKNRGLVAEDLAFIKLMGDIPWNGIFVPDVDTFNFANIRESERADKINKLIGSQNDPIVRHRLAFFYERIKLLESKFGAPDKIVLEFVRDDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGDRTPFEWLSSDKTKWESYCDRVRSLTQSLGAKRCKLLVSPNAEELMQKYTALAETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLEEVVPTKVAIKKPELEQTIYSKRVIGGRQTIVKKCNVRDLAYKGQNPKYDFDTLTKRIKDIINPVSKRVIEDFAKTEPTEAEWEDWCKYEAAIPSKNGSPTRLLRVLVEIGNPEEYKDLSKDGCGAYRKGDSHKGQFIWKNKKGRYIVAPIYAHASKAKVLDDLQNNPDCAEICGFFRTNCLVKIPNDVADKDGKFLLKAGFYKSNTIMASGSVKLTDPNGIIKIVGIQHLMNAGMKRVETNTI

SEQ ID NO: 92 - protein, 1062 aa, Unknown
  Description of Unknown: uncultivated organism with predicted taxonomy: Coraliomargarita sp. CAG:312
  MG1-95 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARATELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 93 - protein, 1059 aa, Unknown
  Description of Unknown: uncultivated organism with predicted taxonomy: unclassified Verrucomicrobia (miscellaneous)
  MG1-96 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANVAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 94 - protein, 1059 aa, Unknown
  Description of Unknown: uncultivated organism with predicted taxonomy: unclassified Verrucomicrobia (miscellaneous)
  MG1-97 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGIVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 95 - protein, 1059 aa, Unknown; identical to SEQ ID NO: 86
  Description of Unknown: uncultivated organism with predicted taxonomy: unclassified Verrucomicrobia (miscellaneous)
  MG1-98 effector

SEQ ID NO: 96 - protein, 1059 aa, Unknown
  Description of Unknown: uncultivated organism with predicted taxonomy: unclassified Verrucomicrobia (miscellaneous)
  MG1-99 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPELKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 97 - protein, 1062 aa, Unknown
  Description of Unknown: uncultivated organism with predicted taxonomy: Coraliomargarita sp. CAG:312
  MG1-100 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINSTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRVSIKYK

SEQ ID NO: 98 - protein, 1055 aa, Unknown
  Description of Unknown: uncultivated organism with predicted taxonomy: unclassified Verrucomicrobia (miscellaneous)
  MG1-101 effector
MENRVNIWGFDIGKGSLGEAVRIGSEIKHVQSLILYKDFGEIKTAAGIRRQYRTRKAHRAREKFLEKVLGECGIEVLRRREVGIVDGCWKLIAKGDIRLEKEFPSPGEDVCYNSIALRCKLLLGEPLESWQVFKALNSAIQNRGYDPDIPWTETDADKKEDSDWAKRLSAYEDEKKVVFSGLADPQRYDYPCFFKAYKMGLWSPEDPEIVKLRIDNHAEKAKNYVIPRKCVEAEFEKLVENASLQYPKLKGKALYIMFGPAQKEYASLNPELRRQFNLKRGADTDWTALGQKIPRFDNRIVDKCKLMPRFNVCKIRSLDEIKNPADFLPYEITTLMKLLNLRFLRNGTIESLACDELKEAFELARDNKYKLSKTALKKFLKKIGAEVLDEDQSKIEAPRSGGRASFSRPAMAVLKELILSGESPAKFYARKVSQIENTDKLKGLVASDFDFIKQMGDIAWGKIFMPDMRLLEFANRQNIDAEARINKLIGSQNDPIVRHRLGFFYDRIKFLESKFGVPDKIVIEFVRDDFLGEKAKKEYQKAINERFKEKQELAKEMDEAGYKGAKMLLKLELYKKQGGQCVYTGEALPSSEIASLEIEHIVPRSRGGPDSIYNYVLTRESTNKEKADMTPYEWLSRNADRWNAYVSRVNSLYKSLGGKRCKLLLANNAEELVDKYTALAETAWISKLAQQVVCLHFGFQFGGMEGQRRVFCIPGGVTARIRGMFGLNELLHVKDYDTDSMSETEIVELHKRLEKKNRENKKHHALDAMCLCFAPTGSQIKRFDAKTIMPEGILGREKQYFKSYLDKIVPNEVATQKPRLEQTLYSKRVVGGKECIVRKFNLIDLAYKSGLKPVYDLQTIKKLVGKDQSESDIINPVVGALVREFIATDPTEEQWRAWCGEVCMPSESFTGSRIKRVLVRCGNPDEFKDLSKDGCGAYRKGDAHKGQIVWRSTNGKCYVMPIYVHASKYGLIEALKKRADFKEIVGLFRMHCLVNIERDVVNKNGQKLLPPGIYMLNTIMTKGTAVLTNTDGVKQKEVNMNYLVESGMRPIKVDY

SEQ ID NO: 99 - protein, 1012 aa, Unknown
  Description of Unknown: uncultivated organism with predicted taxonomy: unclassified Verrucomicrobia (miscellaneous)
  MG1-102 effector
ALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYAALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCAVDVGDVYNDKGDFILPAGRYMVNTIRSDNQCVLTNADGEKRNPININYLMRAGMRRVDLSEL

SEQ ID NO: 100 - protein, 1059 aa, Unknown
  Description of Unknown: uncultivated organism with predicted taxonomy: Verrucomicrobia
  MG1-103 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTLPGALTSRIRKFYGLDRILHISAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVKRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVELSEL

SEQ ID NO: 101 - protein, 1062 aa, Unknown; identical to SEQ ID NO: 81
  Description of Unknown: uncultivated organism with predicted taxonomy: Verrucomicrobia
  MG1-104 effector

SEQ ID NO: 102 - protein, 1059 aa, Unknown
  Description of Unknown: uncultivated organism
  MG1-105 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 103 - protein, 1073 aa, Unknown
  Description of Unknown: uncultivated organism with predicted taxonomy: Verrucomicrobia
  MG1-106 effector
MYTKEIIWGFDIGKGSLGEAVRVGNEFKHVQSLEIASDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENVANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWLSSKGAEWDSYCDRVRELTKNLGAKRCRLLLAPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLATVIPNKVAVEKSKLEQTIYSLRKGRIVKKCNVRDLAYEGINPKYNYTKLVKRIESIVGDVSKRIISDFVLSNPDLKESEWEDWCKYEAAIPSKNGAPTKLLRVLCEVGSPEEYKDLSKDGCGAYRKGDSHKGQFIWKTQKGKYMVAPVYAHASKAKVFAALKSNPDCAEVCGFFRQNCLVEISNDVIDKSGKMLLKAGVYRSNSVRSNGQVAITNSDGISPNPISIQYLMPAGMKRIKLDTV

SEQ ID NO: 104 - protein, 1073 aa, Unknown; identical to SEQ ID NO: 84
  Description of Unknown: uncultivated organism with predicted taxonomy: Verrucomicrobia
  MG1-107 effector

SEQ ID NO: 105 - protein, 1073 aa, Unknown
  Description of Unknown: uncultivated organism with predicted taxonomy: Verrucomicrobia
  MG1-108 effector
MHTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAELQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATELGKIANTDKNKGLVAGDLDFLKLMSDAPWSGIFIPDVGLSDFADTSEAARAAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWHSLKGAEWDSYCDRVRELTKNLGAKRCRLLLAPNAAELVEKYTALAETAWISKLAQRICCLHFGFQFGGLAGAKKVWTVSGNTTAMIRGRYGLNRLLHDEEAAEDLSLFDRICMEKKFEEKNRKNKKHHALDAMCLCFAPTSNAKKASAYKNILPEEITRNPESDEARKFFGRYLATVIPNKVAVEKSKLEQTIYSLRKGRIVKKCNVRDLAYEGINPKYNYTKLVKRIESIVGDVSKRIISDFVLSNPDLKESEWEDWCKYEAAIPSKNGAPTKLLRVLCEVGSPEEYKDLSKDGCGAYRKGDSHKGQFIWKTQKGKYMVAPVYAYASKAKVFAALKSNPDCAEVCGFFRQNCLVEISNDVIDKSGKMLLKSGIYKSNTIMSDGRAKFTNSDGISTNPISIQYLMPAGMKRIKLDTV

SEQ ID NO: 106 - protein, 1059 aa, Unknown
  Description of Unknown: uncultivated organism with predicted taxonomy: unclassified Verrucomicrobia (miscellaneous)
  MG1-109 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRSAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 107 - protein, 1073 aa, Unknown
  Description of Unknown: uncultivated organism with predicted taxonomy: Verrucomicrobia
  MG1-110 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKDKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREEQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGKALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKLEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNPKLSESEWEDWCKNEALIPSKNGAPTKLLRVLCDVGSPEEYKDLSKDGCGAYRKGDSHNGQFIWKTKQGRYVVAPVYAHASKAKVLAALKNNPDCAEVCGFFRQNCLVEIPNDVVDKSGKMLLKSGIYKSNTIMSDGRAKFTNSDGISTNPISIQYLMPAGMKRIKLDTV

SEQ ID NO: 108 - protein, 1062 aa, Unknown; identical to SEQ ID NO: 97
  Description of Unknown: uncultivated organism with predicted taxonomy: Coraliomargarita sp. CAG:312
  MG1-111 effector

SEQ ID NO: 109 - protein, 1059 aa, Unknown; identical to SEQ ID NO: 96
  Description of Unknown: uncultivated organism with predicted taxonomy: unclassified Verrucomicrobia (miscellaneous)
  MG1-112 effector

SEQ ID NO: 110 - protein, 1034 aa, Unknown
  Description of Unknown: uncultivated organism with predicted taxonomy: Verrucomicrobia
  MG1-113 effector
MGAEFRHVASLLLDKDFGEIKTAAGLRRQMRTRKAHKAREKWLERCLSDFGIEPLKRREVGIVNGRWMLISKGDERLEREFPPDGEDICYNAIALRCKLLLGEKLESWQIFKALNSAIQNRGYDENIPWKESDVSPSKKDDDDYAKRLSQYSREKSELLESFEGGEKYDYPCFFKAYKMGLWSPENPERVEIRIGNDAQKAKGYVIPRKDVEREFESLVEAASKWHPAMKGKAMYMMYGIAETPYASFKPSLRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRAAFSRPAMLLLKELIFSGMPPAEFYAKKAGEISNADPNKGIVASDLDFIKLMGNCGWNGIFIPDVETYRFANDGADSAKLINGLIGSQNNPIVRHRLAFFYERIKFLESKFGIPDKVVLEFVREDFMGKEQKKRMQIGMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRIKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRENEKHHALDAMCLCFAPTGVNSKRARIDMLLPPDIRGEGKAELFFRKYLDRLIPVDVAPKKPRLEDGIYSMRAVGGKKFMARRVNLVDLAYTVGQKPVYDISVLIGKKNPKEKKIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKVGNAYNDKGELLLPEGVYMVNTIQTDGRGKLTNPNGEKSNLININYLMKAGMRKVSVKDL

SEQ ID NO: 111 - protein, 1077 aa, Unknown
  Description of Unknown: uncultivated organism with predicted taxonomy: unclassified Verrucomicrobia (miscellaneous)
  MG1-114 effector
MSLYFIEQISDWKIMKVIEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGLVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSYEGFLKRGEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 112 - protein, 1061 aa, Unknown
  Description of Unknown: uncultivated organism with predicted taxonomy: unclassified Verrucomicrobia (miscellaneous)
  MG1-115 effector
MKVIEDEGGNHIWGFDIGKGSLGEAVLDGSEFKHVASLLLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYDENIPWKESDASPSKKEDGDYAQKLSQYSKEKSELFESFEGGEKYDYPCFFKACKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 113 - protein, 1073 aa, Unknown
  Description of Unknown: uncultivated organism with predicted taxonomy: Verrucomicrobia
  MG1-116 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGRYLATVIPNKVAVEKSKLEQTIYSLRKGRIVKKCNVRDLAYEGINPKYNYTKLVKRIESIVGDVSKRIISDFVLYNPDLKESEWEDWCKYEAAIPSKNGAPTKLLRVLCEVGSPEEYKDLSKDGCGAYRKGDSHKGQFIWKTQKGKYMVAPVYAHASKAKVFASLKNNPDCAEVCGFFRQNCLVEIPNDVIDKSGKMLLKAGVYRSNSVRSNGQVAITNSDGISPNPISIQYLMPAGMKRIKLDTV

SEQ ID NO: 114 - protein, 1062 aa, Unknown
  Description of Unknown: uncultivated organism with predicted taxonomy: Coraliomargarita sp. CAG:312
  MG1-117 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 115 - protein, 1059 aa, Unknown
  Description of Unknown: uncultivated organism with predicted taxonomy: unclassified Verrucomicrobia (miscellaneous)
  MG1-118 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDGYAEIEPPKESGRASFSRPAMEILKELIFSGMPPREFYGRKISEISNTDKNKGVVSSDLDFIKLMGDCPWGGIFIPDVQTYLFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 116 - protein, 1059 aa, Unknown
  Description of Unknown: uncultivated organism with predicted taxonomy: unclassified Verrucomicrobia (miscellaneous)
  MG1-119 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKLGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 117 - protein, 1034 aa, Unknown
  Description of Unknown: uncultivated organism with predicted taxonomy: unclassified Verrucomicrobia (miscellaneous)
  MG1-120 effector
MGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPTEFYAKKAGEISNADPNKGIVASDLDFIKLMGNCGWSGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKIGNTYNDKGELLLHEGVYMVNTIQTDGRGKLTNPNGEKSNLININYLMKAGMRKVSVKDL

SEQ ID NO: 118 - protein, 1057 aa, Unknown
  Description of Unknown: uncultivated organism with predicted taxonomy: unclassified Verrucomicrobia (miscellaneous)
  MG1-121 effector
KEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISAIALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIWKSGPCVLTNADGEKRNPININYLMRAGMRRVDLSEL

SEQ ID NO: 119 - protein, 1059 aa, Unknown
  Description of Unknown: uncultivated organism with predicted taxonomy: unclassified Verrucomicrobia (miscellaneous)
  MG1-122 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSKTPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 120 - protein, 1059 aa, Unknown
  Description of Unknown: uncultivated organism with predicted taxonomy: unclassified Verrucomicrobia (miscellaneous)
  MG1-123 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVGPVYVHASKAGVMAALNANPKKKRICGMFNSHCTVDVGDVYNDKGDFILPAGRYMVNTIRSDNQCVLTNADGEKRNPININYLMRTGMRRVDLSEL

SEQ ID NO: 121 - protein, 1073 aa, Unknown
  Description of Unknown: uncultivated organism with predicted taxonomy: Verrucomicrobia
  MG1-124 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEKPTLEQTIYAMRKGRIVKKCNVRDLAYTGINPKYNYSTLVKSIKSIVGEVPKRIISDFVLSNPKLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSIWASGHAQLTNSDGVSPNPISIQYLMPAGMKRIKLDTV

SEQ ID NO: 122 - protein, 1062 aa, Unknown
  Description of Unknown: uncultivated organism with predicted taxonomy: Verrucomicrobia
  MG1-125 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASRFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 123 - protein, 1054 aa, Unknown
  Description of Unknown: uncultivated organism with predicted taxonomy: unclassified Verrucomicrobia (miscellaneous)
  MG1-126 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLVKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 124 - protein, 1073 aa, Unknown; identical to SEQ ID NO: 103
  Description of Unknown: uncultivated organism with predicted taxonomy: Verrucomicrobia
  MG1-127 effector

SEQ ID NO: 125 - protein, 1059 aa, Unknown
  Description of Unknown: uncultivated organism with predicted taxonomy: unclassified Verrucomicrobia (miscellaneous)
  MG1-128 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLQSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVELSEL

SEQ ID NO: 126 - protein, 1073 aa, Unknown
  Description of Unknown: uncultivated organism with predicted taxonomy: Verrucomicrobia
  MG1-129 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRIIDKCKLIPRLNVCRIKPLDKCKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDIGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYTGINPKYNYSTLVKSIKSIVGEVPKRIISDFVLSNPKLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSIWASGHAQLTNSDGVSPNPISIQYLMPAGMKRIKLDTV

SEQ ID NO: 127 - protein, 1059 aa, Unknown
  Description of Unknown: uncultivated organism with predicted taxonomy: unclassified Verrucomicrobia (miscellaneous)
  MG1-130 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKPELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPNESAWRKWCEEVRLPSKSGLGARVMRVLVYYGEADEYKDLSKDGCGAYRKGDEHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 128 - protein, 1077 aa, Unknown; identical to SEQ ID NO: 89
  Description of Unknown: uncultivated organism with predicted taxonomy: unclassified Verrucomicrobia (miscellaneous)
  MG1-131 effector

SEQ ID NO: 129 - protein, 1059 aa, Unknown
  Description of Unknown: uncultivated organism with predicted taxonomy: unclassified Verrucomicrobia (miscellaneous)
  MG1-132 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 130 - protein, 1062 aa, Unknown
  Description of Unknown: uncultivated organism with predicted taxonomy: Coraliomargarita sp. CAG:312
  MG1-133 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASRLKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRISIKYK

SEQ ID NO: 131 - protein, 1061 aa, Unknown
  Description of Unknown: uncultivated organism with predicted taxonomy: unclassified Verrucomicrobia (miscellaneous)
  MG1-134 effector
MKVMEDEGGNHIWGFDIGKGSLGEAVLDGSEFKHVASLLLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYDENIPWKESDASPSKKEDGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRMVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 132 - protein, 1058 aa, Unknown
  Description of Unknown: uncultivated organism with predicted taxonomy: unclassified Verrucomicrobia (miscellaneous)
  MG1-135 effector
MEKEKNNHVWGFDIGKGSLGEAVRIGGDFKHIASVLLDPEFGEIKTAALVRRQMRTRKAHKAREKGLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYAVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSGRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGAMAALNANPKKKRICGMFNSHCTVDVGDVYNDNGDFILPAGRYMVNTIKKNGQCVLSDANNEKNTININYLMRAGMRRIELSEL

SEQ ID NO: 133 - protein, 1073 aa, Unknown
  Description of Unknown: uncultivated organism with predicted taxonomy: Verrucomicrobia
  MG1-136 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVMPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASAAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVKKSALEQTIYALRKGRIVKKCNVRDLAYTGINPKYNYSTLVKSIKSIVGEVPKRIVSDFVLSNSDLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 134 - protein, 1059 aa, Unknown
  Description of Unknown: uncultivated organism with predicted taxonomy: unclassified Verrucomicrobia (miscellaneous)
  MG1-137 effector
MEKEKNNHVWGFDIGKGSLGEAVRIGGDFKHIASVLLDSEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKIGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 135 - protein, 1059 aa, Unknown; identical to SEQ ID NO: 86
  Description of Unknown: uncultivated organism with predicted taxonomy: unclassified Verrucomicrobia (miscellaneous)
  MG1-138 effector

SEQ ID NO: 136 - protein, 1059 aa, Unknown
  Description of Unknown: uncultivated organism with predicted taxonomy: unclassified Verrucomicrobia (miscellaneous)
  MG1-139 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVELSEL

SEQ ID NO: 137 - protein, 1059 aa, Unknown
  Description of Unknown: uncultivated organism with predicted taxonomy: unclassified Verrucomicrobia (miscellaneous)
  MG1-140 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNMGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCAVDVGDVYNDKGDFILPAGRYMVNTIRSDNQCVLTNADGEKRNPININYLMRAGMRRVDLSEL

SEQ ID NO: 138 - protein, 1073 aa, Unknown
  Description of Unknown: uncultivated organism with predicted taxonomy: Verrucomicrobia
  MG1-141 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCRIKPLDECKTDDDFLSYTITLSLKLLNLRFFRGAGMDSLSFDEFLRAFELAKNSKFKLGKAALKKFFKTIGAEVMDESQSEIEQPRNGGRAAFSRPAMRILRDLIFSGKSPADFYATAIENIANTDKNKGLVAGDLDFLKLMGDAPWSGIFIPDVGLSDFADASEAARAAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGNALPLSELENLEIEHIVPRSRGGPDAMYNYVLTDEKTNKEKGDRTPFEWRSTMGAEWESYCARVRELTKKLGAKRCKLLLAPNAAELVEKYTALAETAWISKLAQRICCLHFGFQFGGLAGAKKVWTVSGNTTSMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNSDLSESEWEDWCKNEAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSVRSNGQVAITNSDGISPNPISIQYLMPAGMKRIKLDTV

SEQ ID NO: 139 - protein, 1060 aa, Unknown
  Description of Unknown: uncultivated organism with predicted taxonomy: unclassified Verrucomicrobia (miscellaneous)
  MG1-142 effector
MKVMEGEGGNHIWGFDIGKGSLGEAVLDGSEFKHVASLLLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYENIPWNESDASPSKKEDGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELFEKQGGVCLYTGEPLLPSELGILEIEHIVPRSRGGPDAQYNYVLTREKTNKEKADRTPFEWLSSDPVRWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRMVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGCGAFRRGDGHKGQIVWESTDGKYYVLPIYVHASKAKLLAELCANPKKKRICGIFTSHCMVKVGNTYNNKGELLLPEGVYMVNTIRTDGWIQLTSANGDKSKPININYLMKAGMKKVLVKDL

SEQ ID NO: 140 - protein, 905 aa, Unknown
  Description of Unknown: uncultivated organism with predicted taxonomy: Verrucomicrobia bacterium
  MG1-143 effector
KESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPAFRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLMKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGERKAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKVGNAYNDKGELLLSEGVYMVNTIRTDGWIQLTSANGDKSKPININYLMKAGMRKVSVKDL

SEQ ID NO: 141 - protein, 1025 aa, Unknown
  Description of Unknown: uncultivated organism with predicted taxonomy: unclassified Verrucomicrobia (miscellaneous)
  MG1-144 effector
LLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYDENIPWKESDASPSKKEDGDYAQKLSQYSKEKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGLVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSYEGFLKRVEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 142 - protein, 1073 aa, Unknown
  Description of Unknown: uncultivated organism with predicted taxonomy: Verrucomicrobia
  MG1-145 effector
MYTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKLFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGKALPLSELENLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLATVIPNKVAVEKSKLEQTIYSLRKGRIVKKCNVRDLAYTGINPKYNYSTLVKSIKSIVGEVPKRIVSDFVLSNSDLSESEWEDWCKNEAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKAGVYRSNSVKSNGQVAITNSDGISPNPISIQYLMPAGMKRIKLDTV

SEQ ID NO: 143 - protein, 1059 aa, Unknown
  Description of Unknown: uncultivated organism with predicted taxonomy: unclassified Verrucomicrobia (miscellaneous)
  MG1-147 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAIEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGVRVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 144 - protein, 938 aa, Unknown
  Description of Unknown: uncultivated organism with predicted taxonomy: unclassified Verrucomicrobia (miscellaneous)
  MG1-148 effector
KLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLFNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVDDVYNDKGDFILPAGRYMVNTIRSDNQCVLTNADGEKRNPININYLMRAGMRRVDLSEL

SEQ ID NO: 145 - protein, 1059 aa, Unknown
  Description of Unknown: uncultivated organism with predicted taxonomy: unclassified Verrucomicrobia (miscellaneous)
  MG1-149 effector
MEKEKNNHVWGFDIGKGSLGEAVRIGGDFKHIASVLLDPEFGEIKTAALACRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVTACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 146 - protein, 1062 aa, Unknown
  Description of Unknown: uncultivated organism with predicted taxonomy: Coraliomargarita sp. CAG:312
  MG1-150 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGSDSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIRKDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 147 - protein, 1034 aa, Unknown
  Description of Unknown: uncultivated organism with predicted taxonomy: Verrucomicrobia
  MG1-151 effector
MGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLGGTKRVFTVTGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKVGNAYNDKGELLLPEGVYMVNTIQTDGRGKLTNTNGDKSKPININYLMKAGMRKVSVKDL

SEQ ID NO: 148 - protein, 874 aa, Unknown; identical to SEQ ID NO: 88
  Description of Unknown: uncultivated organism
  MG1-152 effector

SEQ ID NO: 149 - protein, 1059 aa, Unknown
  Description of Unknown: uncultivated organism with predicted taxonomy: unclassified Verrucomicrobia (miscellaneous)
  MG1-153 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAVKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPMDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 150 - protein, 1073 aa, Unknown
  Description of Unknown: uncultivated organism with predicted taxonomy: Verrucomicrobia
  MG1-154 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLVHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYTGINPKYNYSTLVKSIKSIVGEVPKRIISDFVLSNPKLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSIWASGHAQLTNSDGVSPNPISIQYLMPAGMKRIKLDTV

SEQ ID NO: 151 - protein, 1074 aa, Unknown
  Description of Unknown: uncultivated organism with predicted taxonomy: Verrucomicrobia
  MG1-155 effector
MGTKEIVWGFDIGKGSLGEAVRIGNEFKHVQSLEIPPEFAETKTAAALRRAWRTRHAHKARELWLERCLSNAGIEVLGRRKVDIVGGRWKLVSEGDRRLEREFPADGEDCCYNSIALRCKLLLGEKLESWQVFKALNSAIQTRGYDAKIPWGNGNGKTPDSAKGEKSEAVKEEDSYAEKLALYEREFDGLLAEVNNRKKYDFPCFFKAAKIGLWSPENPDVVKIRIDNTAEKAKGYVVPRSAVVSEFRALVEAAAKQYPALKGKADFIMFGVSEEPYASYNPELRKKFGLKRGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFIPDVAAFDFANSTEFSRAVQINKLIGLQNDPIVRHRLSFFYERIKSLEAKFGTPDKIVLEFVRDDFLGKKAKADLSRAINDRAKERKKYAEELDSQREIFGSKYASKKMLLKYELYSKQKGVCVYTGNALGFSNLEQLEVEHIVPRSRGGPDALYNYVLTDEKTNKEKGDRTPFEWLSSKGLEWESYCQRVRELTKEFGAKRCRLLLSPNAEELVEKYTALAETAWISKLAQRVCCIHFGFQFGGLTGVKKVWTVSGNTTAMIRSRYGLNRLLHDENVPKDISLSERLKLENDFEKKNRDNKKHHALDAMCLCYAPTSNTRRAASYKNILPAEITRNPESDEARRFFGRYLANVIPNKVAIEKPTLEQTIYAKRLINGKETIVKKCNVRDLAYAGINPKYDLGKLKDRIRDIINPVSKRVISDFVNSNPNLSESEWEDWCRHEASIPSKSGKATRLLRVQCAVGDPAEYKDLSKDGCGAYRKGKSHKGQYIWKTKGGRYVVTPVYTFASKIRVYDDMRRDPNCEEICGFFRQNCLVEIPNDVYDSKGVWKLKAGIYRSNTIRADGFVKLTNSDGFSSNPISIQYLMTAGMKRITLDTI

SEQ ID NO: 152 - protein, 891 aa, Unknown
  Description of Unknown: uncultivated organism with predicted taxonomy: Coraliomargarita sp. CAG:312
  MG1-156 effector
LYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGSDSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 153 - protein, 1055 aa, Unknown
  Description of Unknown: uncultivated organism with predicted taxonomy: Verrucomicrobia
  MG1-157 effector
MENRVNIWGFDIGKGSLGEAVRIGSEIKHVQSLILDKDFGEIKTAAGIRRQYRTRKAHRAREKFLEKVLGECGIEVLRRREVGIVDGCWKLIAKGDIRLEKEFPSPGEDVCYNSIALRCKLLLGEPLESWQVFKALNSAIQNRGYDPDIPWTETDADKKEDSDWAKRLSAYEDEKKVLFSGLADPQRYDYPCFFKAYKMGLWSPEDPEIVKLRIDNHAEKAKNYVIPRKCVEAEFEKLVENASLQYPKLKGKALYIMFGPAQKEYASLNPELRRQFNLKRGADTDWTALGQKIPRFDNRIVDKCKLMPRFNVCKIKPLDEIKNPADFLPYEITTLMKLLNLRFLRNGTIESLACDELKEAFELARDNKYKLSKTALKKFLKKIGAEVLDEDQSKIEAPRSGGRASFSRPAMAVLKELILSGESPAKFYARKVSQIENTDKLKGLVASDFDFIKQMGDIAWGKIFMPDMRLLEFANRQNIDAEARINKLIGSQNDPIVRHRLGFFYDRIKFLESKFGVPDKIVIEFVRDDFLGEKAKKEYQKAINERFKEKQELAKEMDEAGYKGAKMLLKLELYKKQGGQCVYTGEALPSSEIASLEIEHIVPRSRGGPDSIYNYVLTRERTNKEKADRTPYEWLSRDQQRWNAYVSRVNSLYKSLGGKRCKLLLANNAEELVDKYTALAETAWISKLAQQVVCLHFGFQFGGMEGQRRVFCIPGGVTARIRGMFGLNELLHVKDYDTDSMSETEIVELYKRLEKKNRENKKHHALDAMCLCFAPTGSQIKRFDAKTIMPEGILGREKQYFKSYLDKIVPNEVATQKPRLEQTLYSKRVVGGKECIVRKFNLVDLAYKSGLKPVYDLQTIKKLVGKDQSESDIINPVVGALVREFIATDPTEEQWRAWCGEVCMPSESFTGSRIKRVLVRCGNPDEFKDLSKDGCGAYRKGDAHKGQTVWRSTNGKCYVLPIYVHASKYGLIEALKKRADFKEIVGLFRMHCLVNIERDVFDKKGQKLLPPGIYMLNTLRADSQALLTNTDGVKQKAININYLVESGMRPIKVDY

SEQ ID NO: 154 - protein, 1061 aa, Unknown
  Description of Unknown: uncultivated organism with predicted taxonomy: unclassified Verrucomicrobia (miscellaneous)
  MG1-158 effector
MKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVTARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYYVLPIYVHASKAKLPAELCANPKKKRICGIFTSHCMVKVGNTYNNKGELLLPEGVYMLNTIRTDGWIQLTSANGDKSKPININYLMKAGMKKVPVKDL

SEQ ID NO: 155 - protein, 1052 aa, Unknown
  Description of Unknown: uncultivated organism with predicted taxonomy: Coraliomargarita sp. CAG:312
  MG1-159 effector
MDILGNKVWGFDMGKGSLGEAVRIGNEFKHVCSLLLDADFGEIKTAASLRRQYRTHKAHKAREKWLEDCLRKCGIEVLQRRQVAFVDDKWQLVSKGDIRLEKEFPTDDENICYNSIALRCKLILGEKLESWQVFKALNSAIQNRGYDSEIPWKETEVKSKDNSDYAIKLQAFEREKDELLLNLPSIDEAIRSKFDYPCFFKAYKIGLWNPVNPNQVDSKISHTANKAKGYVIPRNYVEKEFIKLVEMASLQYPKLRNKALFILYGITEKPYASFDFDLRKKFNLKRGAESDWTALGQKIPRFDNRIVDKCKLIPRFNVCKVKHIDEIQQDKDFLYYEITLAMKLLNLRFYRNANVQSLNYDEFKILFEIGKANKFKITKTNLKKFLNSINAEILDENQAEVAQPKDSGRASFSRPAMQLIKELIFSGQSPADFYARKVSSISNVETKKGLVVEDLDFIKLMGDVDWNGIFIPDVETYKFAKNFSEDNSAQINKLIGMQNDPIVRHRLSFFYDRIKYLEAKFGIPDKVVLEFVRDDFIGKEKKKELNIAIKKRYSEKLKIAEKLDEIGFKGSKMLMKLELFQKQGGICLYTREPLLPTEIPSLEIEHIVPRSRGGPDSAYNFVLTREATNKEKANRTPFEWLSGDSQKWVSYSDRVMSRSKELGKKRCQLLLKENAEELVEKYTALAETAWIARLAQRIVCMHFGFPMGALIGKKRVFTVSGSVTSRIRGMYGLNKILHNTEIDKTLSEVDILKLNDSLETKNRANKKHHALDAMCLCFAPTSKEVLNKNREILPVEIAKDAENYFRRYLDNIIPNKVATMKPRLEETIYSKRKIGKKEYIVRKYDLESLAYKGINPKYDVESIKKLANSENIINVVARKIIRDFVNDNPTEQEWKDFCNTVKMPSKNGNGSRLKRILLLVGNTAEYKDLSKDGCGAYRKGDSHKGQIIWKTKSGKFKVEPIYAHSSRAKVSKELMKKPEFDSVAGIFRTGCLVEFTNDVMNDKDEFLLERGIYSLNTISTAGQVAITNSNGNKSIGININYLMKAGMRRLNL

SEQ ID NO: 156 - protein, 933 aa, Unknown
  Description of Unknown: uncultivated organism with predicted taxonomy: unclassified Verrucomicrobia (miscellaneous)
  MG1-160 effector
EKLEGWQVFTALNSAIQKRGYDENIPWGEAEEKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISPTALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRTGMRRVDLSEL

SEQ ID NO: 157 - protein, 1074 aa, Unknown
  Description of Unknown: uncultivated organism with predicted taxonomy: Verrucomicrobia
  MG1-161 effector
MGTKEIVWGFDIGKGSLGEAVRIGNEFKHVQSLEIPPEFAETKTAAALRRAWRTRHAHKARELWLERCLSNAGIEVLGRRKVDIVGGRWKLVSEGDRRLEREFPADGEDCCYNSIALRCKLLLGEKLESWQVFKALNSAIQTRGYDAKIPWGNDDGKTSDSAKGGKSEAAKEEESYAEKLALYEREFDGLLAEVDNRKKYDFPCFFKAAKIGLWSPANPDAVKIRIDNTAEKAKGYVVPRSAVIAEFRALVDAAAKQYPALKGKADFIMFGVSEEPYASYNPELRKKFGLKRGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFVPDVGVFDFADSTECSRAVQINKLIGMQNDPIVRHRLSFFYGRIKSLDAEFGTPDKIVLEFVRDDFLGKKAKADLSKAINDRAKEKKKYAEELDSQRENFGPKYASKKMLLKYELYSKQKGECIYTGRALGFSDLEQLEVEHIVPRSRGGPDALYNYVLTDEKTNKDKGDRTPFEWLSSKGVEWDAYRDRVRGLTKELGAKRCKLLLSPNAEELVEKYTALAETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEKPTLEQTIYAKRLIEGRETIVKKCNVRDLAYAGINPKYDLGKLKDRIRDIINPVSKRVISDFVNSNPNLSESEWEDWCRHEASIPSKSDKATRLLRVQCAVGDPAEYKDLSKDGCGAYRKGKSHKGQYIWKTKGGRYVVTPVYTFASKIRVYDDMRRDPNCEEICGFFRQNCLVEIPNDVYDNKGVLKLKAGIYRSNTIKTNGQVNLTTPNGIKFNGISIQYLMSAGMKRITLNTI

SEQ ID NO: 158 - protein, 1062 aa, Unknown
  Description of Unknown: uncultivated organism with predicted taxonomy: Coraliomargarita sp. CAG:312
  MG1-162 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIIGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNSKRDVLLSPGTYMINTIMAAGMAILSDTNGVKSPAININYLMNAGMRRISIKYK

SEQ ID NO: 159 - protein, 1063 aa, Unknown
  Description of Unknown: uncultivated organism with predicted taxonomy: unclassified Verrucomicrobia (miscellaneous)
  MG1-163 effector
MKVIEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLPREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSFEGFLKRGEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 160 - protein, 1074 aa, Unknown
  Description of Unknown: uncultivated organism with predicted taxonomy: Verrucomicrobia
  MG1-164 effector
MHTKETVWGFDIGKGSLGEAVRVGNEFKHVLSMEIDADFAEIKTAAATRRAWRTREAHKAREMWLEKCLSDADIEILGRRKVDIVDGTWKLVSRGDGRLEREFPADGENVCYNSIALRCKLLLGEKLESWQVFKALNSAIQNRGYDAQIPWGDEDGKSSETKRSGKSDSAKKSGEDESYAERLALFEREFDKLLAEVENREKYDFPCFFKAAKMGLWSPENPDKVGIRIDNTAEKAKGYVVPRNAVIAEFRALVNAAAKQYPKLKGKADFIMFGKAEEAYASYKPELRRKFGLRRGADSDWTALGQKTPRFDNRIIGKCKLIPRLNVCKIKPLKECKTEDDFLPHTITLALKLLNLRFFRGAGIDSLSFDEFLRAFEIARQNKFALNKTNLKKFFKTIGAEIMDENQSSVEQPREGGRAAYSRPAMRLLRDLIFSGKSPAEFYASRICKIENTDKNRGLVAEDLAFIKLMGDIPWNGIFVPDVDTFNFANIRESERADKINKLIGSQNDPIVRHRLAFFYERIKLLESKFGAPDKIVLEFVRDDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGERTPFEWLSSDKTKWESYCDRVRSLTQSLGAKRCKLLVSPNAEELMQKYTALAETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARKFFAKYLAEVVPTKVAIKKPELEQTIYSKRVIGGRQTIVKKCNVRDLAYKGQNPKYDFDTLTKRIKDIINPVSKRVIEDFAKTEPTEAEWEDWCKYEAAIPSKNGSPTRLLRVLVEIGNPEEYKDLSKDGCGAYRKGDSHKGQFIWKNKKGRYIVAPIYAHASKAKVLDDLQNNPDCAEICGFFRTNCLVKIPNDVADKDGKILLKAGFYKSNTIKTEGRVKLTNPNGIITEIGLQHLMNAGMKRVETNTI

SEQ ID NO: 161 - protein, 1059 aa, Unknown
  Description of Unknown: uncultivated organism with predicted taxonomy: unclassified Verrucomicrobia (miscellaneous)
  MG1-165 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEMRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 162 - protein, 1059 aa, Unknown
  Description of Unknown: uncultivated organism with predicted taxonomy: unclassified Verrucomicrobia (miscellaneous)
  MG1-166 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDGQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKGLGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLEKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGEFILPAGRYMVNTIRSDNQCVLTNADGEKRNPININYLMRAGMRRVDLSEL

SEQ ID NO: 163 - protein, 1055 aa, Unknown
  Description of Unknown: uncultivated organism with predicted taxonomy: unclassified Verrucomicrobia (miscellaneous)
  MG1-167 effector
KNNHVWGFDIGKGSLGEAVRIGGDFKHIASVLLDPEFGEIKTAALARRQMRTRKAHKAREKWLEECLEGTGVEILKRREVGIVDGQWRLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAVFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 164 - protein, 988 aa, Unknown
  Description of Unknown: uncultivated organism with predicted taxonomy: Verrucomicrobia
  MG1-168 effector
GRWKLVSEGDRRLEREFPADGEDCCYNSIALRCKLLLGEKLESWQVFKALNSAIQTRGYDAKIPWGNDDGKTSDSAKGGKSEAAKEEESYAEKLALYEREFDGLLAEVDNRKKYDFPCFFKAAKIGLWSPANPDAVKIRIDNTAEKAKGYVVPRSAVIAEFRALVDAAAKQYPALKGKADFIMFGVSEEPYASYNPELRKKFGLERGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFVPDVGVFDFADSTECSRAVQINKLIGMQNDPIVRHRLSFFYGRIKSLDAEFGTPDKIVLEFVRDDFLGKKAKADLSKAINDRAKEKKKYAEELDSQRENFGPKYASKKMLLKYELYSKQKGECIYTGRALGFSDLEQLEVEHIVPRSRGGPDALYNYVLTDEKTNKDKGDRTPFEWLSSKGVEWDAYRDRVRGLTKELGAKRCKLLLSPNAEELVEKYTALAETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEKPTLEQTIYAKRLINGKETIVKKCNVRDLAYAGRNPQYSYLTLVKNIKCIVGKVSKNIISDFVLSNPDLNESEWENWCKYDAVIPSKNGAPTKLLRVLCGARNPEEYKDLSKDGCGAYRKGNLHKGQFVWKTKQGCYVVTPVYAFESKIKVWDDMRRDPNCEEICGFFRQNCLVEIPNDVYDSKGVLKLKAGVYRSNTIRADGFVKLTNSDGFSPNPISIQYLMSAGMKRITLNTI

SEQ ID NO: 165 - protein, 991 aa, Unknown
  Description of Unknown: uncultivated organism with predicted taxonomy: unclassified Verrucomicrobia (miscellaneous)
  MG1-169 effector
ECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNESRNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVDLNEL

SEQ ID NO: 166 - protein, 872 aa, Unknown
  Description of Unknown: uncultivated organism with predicted taxonomy: unclassified Verrucomicrobia (miscellaneous)
  MG1-170 effector
DGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNESRNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVDLNEL

SEQ ID NO: 167 - protein, 1064 aa, Unknown
  Description of Unknown: uncultivated organism with predicted taxonomy: unclassified Verrucomicrobia (miscellaneous)
  MG1-171 effector
EFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNESRNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGDNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVDLNEL

SEQ ID NO: 168 - protein, 1073 aa, Unknown; identical to SEQ ID NO: 133
  Description of Unknown: uncultivated organism with predicted taxonomy: Verrucomicrobia
  MG1-172 effector

SEQ ID NO: 169 - protein, 1046 aa, Unknown
  Description of Unknown: uncultivated organism with predicted taxonomy: unclassified Verrucomicrobia (miscellaneous)
  MG1-173 effector
IGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACTKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKSDFILPAGRYMVNTIRSDNQCVLTNADGEKRNPININYLMRAGMRRVDLSEL

SEQ ID NO: 170 - protein, 1059 aa, Unknown; identical to SEQ ID NO: 86
  Description of Unknown: uncultivated organism with predicted taxonomy: unclassified Verrucomicrobia (miscellaneous)
  MG1-174 effector

SEQ ID NO: 171 - protein, 918 aa, Unknown
  Description of Unknown: uncultivated organism with predicted taxonomy: Coraliomargarita sp. CAG:312
  MG1-175 effector
AADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEKSKLEQTIYSLRKGRIVKKCNVRDLAYEGINPKYNYTKLVKRIESIVGDVSKRIISDFVLSNPDLNESEWEEWCKYKAAIPSKNGAPTKLLRVLFDVGSPEEYKDLSKDGCGAYRKGDSHKGQFIWKTQKGKYMVAPVYAHASKAKVFASLKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 172 - protein, 1059 aa, Unknown
  Description of Unknown: uncultivated organism with predicted taxonomy: unclassified Verrucomicrobia (miscellaneous)
  MG1-176 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYAALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCAVDVGDVYNDKGDFILPAGRYMVNTIRSDNQCVLTNADGEKRNPININYLMRAGMRRVDLSEL

SEQ ID NO: 173 - protein, 1073 aa, Unknown; identical to SEQ ID NO: 142
  Description of Unknown: uncultivated organism with predicted taxonomy: Verrucomicrobia
  MG1-177 effector

SEQ ID NO: 174 - protein, 1052 aa, Unknown; identical to SEQ ID NO: 155
  Description of Unknown: uncultivated organism with predicted taxonomy: Coraliomargarita sp. CAG:312
  MG1-178 effector

SEQ ID NO: 175 - protein, 846 aa, Unknown
  Description of Unknown: uncultivated organism with predicted taxonomy: Coraliomargarita sp. CAG:312
  MG1-179 effector
TLFRSAEKAKGYVVPREAVVREFRALVNAAALQYPNLKGKADFIMFGRACEPYASYNPELRKRFGLKRGAATDWTALGQKTPRFDNRVIDKCKLIPRLNVCRIKPLDECKTDDDFLSYTITLSLKLLNLRFFRGAGMDSLSFDEFLRAFELAKNSKFKLGKAALKKFFKTIGAEVMDESQSEIEQPRNGGRAAFSRPAMRILRDLIFSGKSPADFYATAIENIANTDKNKGLVAGDLDFLKLMGDAPWSGIFIPDVGLSDFADASEAARAAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGNALPLSELENLEIEHIVPRSRGGPDAMYNYVLTDEKTNKEKGDRTPFEWRSTMGAEWESYCARVRELTKKLGAKRCKLLLAPNAAELVEKYTALAETAWISKLAQRICCLHFGFQFGGLAGAKKVWTVSGNTTSMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNSDLSESEWEDWCKNEAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSVRSNGQVAITNSDGISPNPISIQYLMPAGMKRIKLDTV

SEQ ID NO: 176 - protein, 1018 aa, Unknown
  Description of Unknown: uncultivated organism with predicted taxonomy: unclassified Verrucomicrobia (miscellaneous)
  MG1-180 effector
IASVLLDPEFGEIKTAALVRRQMRTRKAHKAREKWLEECLEGTGVVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEMRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATSLGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVNACAKALGKKRCRLLLEKDAEELVEKYTALAETAHIAKLAQKIVCMHFGFQFGGVSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 177 - protein, 1077 aa, Unknown; identical to SEQ ID NO: 111
  Description of Unknown: uncultivated organism with predicted taxonomy: unclassified Verrucomicrobia (miscellaneous)
  MG1-181 effector

SEQ ID NO: 178 - protein, 1061 aa, Unknown; identical to SEQ ID NO: 112
  Description of Unknown: uncultivated organism with predicted taxonomy: unclassified Verrucomicrobia (miscellaneous)
  MG1-182 effector

SEQ ID NO: 179 - protein, 1062 aa, Unknown; identical to SEQ ID NO: 92
  Description of Unknown: uncultivated organism with predicted taxonomy: Coraliomargarita sp. CAG:312
  MG1-183 effector

SEQ ID NO: 180 - protein, 1059 aa, Unknown; identical to SEQ ID NO: 127
  Description of Unknown: uncultivated organism with predicted taxonomy: unclassified Verrucomicrobia (miscellaneous)
  MG1-184 effector

SEQ ID NO: 181 - protein, 1062 aa, Unknown; identical to SEQ ID NO: 122
  Description of Unknown: uncultivated organism with predicted taxonomy: Coraliomargarita sp. CAG:312
  MG1-185 effector

SEQ ID NO: 182 - protein, 1054 aa, Unknown; identical to SEQ ID NO: 123
  Description of Unknown: uncultivated organism with predicted taxonomy: unclassified Verrucomicrobia (miscellaneous)
  MG1-186 effector

SEQ ID NO: 183 - protein, 957 aa, Unknown
  Description of Unknown: uncultivated organism with predicted taxonomy: Verrucomicrobia
  MG1-187 effector
LRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYEGINPKYNYTKLVKRIESIVGDVSKRIISDFVLSNPDLNESEWEEWCKYKAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 184 - protein, 1062 aa, Unknown
  Description of Unknown: uncultivated organism with predicted taxonomy: Verrucomicrobia
  MG1-188 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQENSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKTKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 185 - protein, 1073 aa, Unknown; identical to SEQ ID NO: 113
  Description of Unknown: uncultivated organism with predicted taxonomy: Verrucomicrobia
  MG1-189 effector

SEQ ID NO: 186 - protein, 1059 aa, Unknown; identical to SEQ ID NO: 90
  Description of Unknown: uncultivated organism with predicted taxonomy: unclassified Verrucomicrobia (miscellaneous)
  MG1-190 effector

SEQ ID NO: 187 - protein, 1059 aa, Unknown
  Description of Unknown: uncultivated organism with predicted taxonomy: unclassified Verrucomicrobia (miscellaneous)
  MG1-191 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGENVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVELSEL

SEQ ID NO: 188 - protein, 1081 aa, Unknown
  Description of Unknown: uncultivated organism with predicted taxonomy: unclassified Verrucomicrobia (miscellaneous)
  MG1-192 effector
YYIVDFCSHCKYFNNNKEFNKNMEKEKNNHVWGFDIGKGSLGEAVRIGGDFKHIASVLLDPEFGEIKTAALVRRQMRTRKAHKAREKWLEECLEGTGIEILKRREVGIVDGQWRLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRSGMRRVDLSEL

SEQ ID NO: 189 - protein, 1073 aa, Unknown; identical to SEQ ID NO: 150
  Description of Unknown: uncultivated organism with predicted taxonomy: Verrucomicrobia
  MG1-193 effector

SEQ ID NO: 190 - protein, 1059 aa, Unknown; identical to SEQ ID NO: 129
  Description of Unknown: uncultivated organism with predicted taxonomy: unclassified Verrucomicrobia (miscellaneous)
  MG1-194 effector

SEQ ID NO: 191 - protein, 1059 aa, Unknown; identical to SEQ ID NO: 93
  Description of Unknown: uncultivated organism with predicted taxonomy: unclassified Verrucomicrobia (miscellaneous)
  MG1-195 effector

SEQ ID NO: 192 - protein, 935 aa, Unknown
  Description of Unknown: uncultivated organism with predicted taxonomy: Verrucomicrobia
  MG1-196 effector
MGAEFRHVTSLLLDEDFGEIKTAAGLRRQIRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPAFRKKFDLKRGAESDWTALGQKIPRFDNRIIDKCRPIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPTEDEWRKWCGECRLPSKNGIGTRVIRVLLNYGEPAEYKDLSKDGRGAFRRGDGHKGQIVWESTDGK

SEQ ID NO: 193 - protein, 1059 aa, Unknown; identical to SEQ ID NO: 116
  Description of Unknown: uncultivated organism with predicted taxonomy: unclassified Verrucomicrobia (miscellaneous)
  MG1-197 effector

SEQ ID NO: 194 - protein, 1059 aa, Unknown
  Description of Unknown: uncultivated organism with predicted taxonomy: unclassified Verrucomicrobia (miscellaneous)
  MG1-198 effector
MEKEKNNHVWGFDIGIGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPCFDNRIIDKCRLIPRMNVCKIRPLNEARNEKDLLYYEVTLALKLLNLRFFRNSNIEQLTFEEFKEAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKAFGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 195 - protein, 899 aa, Unknown
  Description of Unknown: uncultivated organism with predicted taxonomy: unclassified Verrucomicrobia (miscellaneous)
  MG1-199 effector
SKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPCFDNRIIDKCRLIPRMNVCKIRPLNEARNEKDLLYYEVTLALKLLNLRFFRNSNIEQLTFEEFKEAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKAFGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 196 - protein, 1073 aa, Unknown
  Description of Unknown: uncultivated organism
  MG1-200 effector
MYTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYECIKSLEAKFGVPDKIVLEFVRDDFLGKKAKSDLNKAIKTRFDEKKKLAEDLDSKREEFGFKYASKKMLLKFELYKKQGGKCVYTGNALPLSELESLEIEHIVPRSRGGPDAMYNYVLTDEKTNKEKGDRTPFEWLSTMGAEWESYCERVRKLTKELGAKRCKLLLSPNAAELVEKYTALAETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNPKLSESEWEDWCKNEALIPSKNGAPTKLLRVLCDVGSPEEYKDLSKDGCGAYRKGDSHKGQFIWETKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 197 - protein, 1073 aa, Unknown; identical to SEQ ID NO: 121
  Description of Unknown: uncultivated organism with predicted taxonomy: Verrucomicrobia
  MG1-201 effector

SEQ ID NO: 198 - protein, 1073 aa, Unknown
  Description of Unknown: uncultivated organism with predicted taxonomy: Coraliomargarita sp. CAG:312
  MG1-202 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYYPELRKRFGLKRGAATDWTALGQKTPRFDNRVIDKCKLIPRLNVCEIKPLDKCKTDDDFLSYTITLSLKLLNLRFFRGAGVDSLSFDEFLRAFELAKNSKFKLGKAALKKFFKTIGAEVMDESQSEIEQPRNEGRAAFSRPAMRILRDLIFSGKSPAEFYAAAIENIANTDKNKGLVAGDLDFLKLMGDAPWSGIFIPDVGLSDFADTSEAAREAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGKALPLSELENLEIEHIVPRSRGGPDAMYNYVLTDEKTNKEKGDRTPFEWRSTMGAEWESYCERVRKLTKELGAKRCKLLLAPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYEGINPKYNYTKLVKRIESIVGDVSKRIISDFVLSNPDLNESEWEEWCKYKAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 199 - protein, 1062 aa, Unknown; identical to SEQ ID NO: 146
  Description of Unknown: uncultivated organism with predicted taxonomy: Coraliomargarita sp. CAG:312
  MG1-203 effector

SEQ ID NO: 200 - protein, 1073 aa, Unknown; identical to SEQ ID NO: 107
  Description of Unknown: uncultivated organism with predicted taxonomy: Verrucomicrobia
  MG1-204 effector

SEQ ID NO: 201 - protein, 759 aa, Unknown
  Description of Unknown: uncultivated organism with predicted taxonomy: Coraliomargarita sp. CAG:312
  MG1-205 effector
FPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEKSKLEQTIYSLRKGRKIGRA

SEQ ID NO: 202 - protein, 1062 aa, Unknown; identical to SEQ ID NO: 130
  Description of Unknown: uncultivated organism with predicted taxonomy: Coraliomargarita sp. CAG:312
  MG1-206 effector

SEQ ID NO: 203 - protein, 1036 aa, Unknown
  Description of Unknown: uncultivated organism with predicted taxonomy: unclassified Verrucomicrobia (miscellaneous)
  MG1-207 effector
MKVMEAENGNHIWGFDIGKGSLGEAVLMGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARDEGDLLHYEITLSLKLLNLRFFRNSNVESLSFEEFKAAFEIAKGAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPTEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKIGNTYNDKGELLLHEGVYMVNTIKTDGRGKLTNPN

SEQ ID NO: 204 - protein, 1059 aa, Unknown
  Description of Unknown: uncultivated organism with predicted taxonomy: unclassified Verrucomicrobia (miscellaneous)
  MG1-208 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 205 - protein, 1059 aa, Unknown; identical to SEQ ID NO: 106
  Description of Unknown: uncultivated organism with predicted taxonomy: unclassified Verrucomicrobia (miscellaneous)
  MG1-209 effector

SEQ ID NO: 206 - protein, 1059 aa, Unknown
  Description of Unknown: uncultivated organism with predicted taxonomy: unclassified Verrucomicrobia (miscellaneous)
  MG1-210 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVDLSEL

SEQ ID NO: 207 - protein, 1062 aa, Unknown; identical to SEQ ID NO: 83
  Description of Unknown: uncultivated organism with predicted taxonomy: Coraliomargarita sp. CAG:312
  MG1-211 effector

SEQ ID NO: 208 - protein, 1059 aa, Unknown; identical to SEQ ID NO: 85
  Description of Unknown: uncultivated organism with predicted taxonomy: unclassified Verrucomicrobia (miscellaneous)
  MG1-212 effector

SEQ ID NO: 209 - protein, 798 aa, Unknown
  Description of Unknown: uncultivated organism with predicted taxonomy: unclassified Verrucomicrobia (miscellaneous)
  MG1-213 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLR

SEQ ID NO: 210 - protein, 920 aa, Unknown
  Description of Unknown: uncultivated organism with predicted taxonomy: unclassified Verrucomicrobia (miscellaneous)
  MG1-214 effector
MLEVAAYAHGLAERAFSDVKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRCAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 211 - protein, 1059 aa, Unknown; identical to SEQ ID NO: 137
  Description of Unknown: uncultivated organism with predicted taxonomy: unclassified Verrucomicrobia (miscellaneous)
  MG1-215 effector

SEQ ID NO: 212 - protein, 1059 aa, Unknown
  Description of Unknown: uncultivated organism with predicted taxonomy: unclassified Verrucomicrobia (miscellaneous)
  MG1-216 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDQLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVIIREKTNKLKGDKTPYEWLSSDAKEWASYTDRVNACAKALGKKRCRLLLEKDAEELVEKYTALAETAHIAKLAQKIVCMHFGFQFGGLSGAKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVELSEL

SEQ ID NO: 213 - protein, 777 aa, Unknown
  Description of Unknown: uncultivated organism with predicted taxonomy: Coraliomargarita sp. CAG:312
  MG1-217 effector
GSDSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 214 - protein, 1059 aa, Unknown; identical to SEQ ID NO: 125
  Description of Unknown: uncultivated organism with predicted taxonomy: unclassified Verrucomicrobia (miscellaneous)
  MG1-218 effector

SEQ ID NO: 215 - protein, 1059 aa, Unknown
  Description of Unknown: uncultivated organism with predicted taxonomy: unclassified Verrucomicrobia (miscellaneous)
  MG1-219 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRTGMRRVDLSEL

SEQ ID NO: 216 - protein, 1059 aa, Unknown
  Description of Unknown: uncultivated organism with predicted taxonomy: unclassified Verrucomicrobia (miscellaneous)
  MG1-220 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEGKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCHLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 217 - protein, 759 aa, Unknown
  Description of Unknown: uncultivated organism with predicted taxonomy: unclassified Verrucomicrobia (miscellaneous)
  MG1-221 effector
FNNNKEFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFAVPGALTSRIRKFYGLDRILHNSEAESENLSFEE

SEQ ID NO: 218 - protein, 1059 aa, Unknown
  Description of Unknown: uncultivated organism with predicted taxonomy: unclassified Verrucomicrobia (miscellaneous)
  MG1-222 effector
MEKEKNNHVWGFDIGKGSLGEAVRIGGDFKHISSVLLDPEFGEIKTAALARRQMRTRKAHKAREKWLEECLEGTGVEILKRREVGIVDGQWQLISKGDERLEREFPPSDEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVGPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 219 - protein, 1059 aa, Unknown
  Description of Unknown: uncultivated organism with predicted taxonomy: unclassified Verrucomicrobia (miscellaneous)
  MG1-223 effector
MEKEKNNHVWGFDIGKGSLGEAVRIGGDFKHIASVLLDPEFGEIKTAALVRRQMRTRKAHKAREKWLEECLEGMGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGRLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 220 - protein, 1025 aa, Unknown; identical to SEQ ID NO: 141
  Description of Unknown: uncultivated organism with predicted taxonomy: unclassified Verrucomicrobia (miscellaneous)
  MG1-224 effector

SEQ ID NO: 221 - protein, 1062 aa, Unknown; identical to SEQ ID NO: 81
  Description of Unknown: uncultivated organism with predicted taxonomy: Coraliomargarita sp. CAG:312
  MG1-225 effector

SEQ ID NO: 222 - protein, 1062 aa, Unknown; identical to SEQ ID NO: 114
  Description of Unknown: uncultivated organism with predicted taxonomy: Coraliomargarita sp. CAG:312
  MG1-226 effector

SEQ ID NO: 223 - protein, 899 aa, Unknown
  Description of Unknown: uncultivated organism with predicted taxonomy: Coraliomargarita sp. CAG:312
  MG1-227 effector
MNNNNTQIWGFDIGKASLGEAVWCGGEFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASRFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIIGDCPWNGIFIPDVETYKYASQTQESSEAQINKLIGSQNDPIVRHRLSFFYERIKALSEKFGVPDKIVLEFVREDFMGKQAKKDLSLYMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNED

SEQ ID NO: 224 - protein, 1059 aa, Unknown
  Description of Unknown: uncultivated organism with predicted taxonomy: unclassified Verrucomicrobia (miscellaneous)
  MG1-228 effector
MEKEKNNHVWGFDIGKGSIGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLGFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSEAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFTATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVCNDKGDFILPAGRYMVNTILTTGRCVLTNADGEKRNPININYLMRAGMRRVDLNEL

SEQ ID NO: 225 - protein, 1059 aa, Unknown
  Description of Unknown: uncultivated organism with predicted taxonomy: Verrucomicrobia
  MG1-229 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETSYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGYDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRSGMRRVDLNEL

SEQ ID NO: 226 - protein, 1059 aa, Unknown
  Description of Unknown: uncultivated organism with predicted taxonomy: Verrucomicrobia
  MG1-230 effector
MEKEKNNHVWGFDIGKGSLGEAVCIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTTLAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVDLSEL

SEQ ID NO: 227 - protein, 1059 aa, Unknown; identical to SEQ ID NO: 87
  Description of Unknown: uncultivated organism with predicted taxonomy: unclassified Verrucomicrobia (miscellaneous)
  MG1-231 effector

SEQ ID NO: 228 - protein, 1073 aa, Unknown; identical to SEQ ID NO: 126
  Description of Unknown: uncultivated organism with predicted taxonomy: Verrucomicrobia
  MG1-232 effector

SEQ ID NO: 229 - protein, 1034 aa, Unknown; identical to SEQ ID NO: 110
  Description of Unknown: uncultivated organism
  MG1-233 effector

SEQ ID NO: 230 - protein, 1058 aa, Unknown
  Description of Unknown: uncultivated organism with predicted taxonomy: unclassified Verrucomicrobia (miscellaneous)
  MG1-234 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYAVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSGRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGAMAALNANPKKKRICGMFNSHCTVDVGDVYNDNGDFILPAGRYMVNTIKKNGQCVLSDANNEKNTININYLMRAGMRRIELSEL

SEQ ID NO: 231 - protein, 1059 aa, Unknown; identical to SEQ ID NO: 115
  Description of Unknown: uncultivated organism with predicted taxonomy: unclassified Verrucomicrobia (miscellaneous)
  MG1-236 effector

SEQ ID NO: 232 - protein, 1056 aa, Unknown
  Description of Unknown: uncultivated organism with predicted taxonomy: Verrucomicrobia
  MG1-237 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 233 - protein, 1062 aa, Unknown; identical to SEQ ID NO: 97
  Description of Unknown: uncultivated organism with predicted taxonomy: Coraliomargarita sp. CAG:312
  MG1-238 effector

SEQ ID NO: 234 - protein, 1061 aa, Unknown; identical to SEQ ID NO: 131
  Description of Unknown: uncultivated organism with predicted taxonomy: unclassified Verrucomicrobia (miscellaneous)
  MG1-239 effector

SEQ ID NO: 235 - protein, 1059 aa, Unknown
  Description of Unknown: uncultivated organism with predicted taxonomy: unclassified Verrucomicrobia (miscellaneous)
  MG1-240 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLNEL

SEQ ID NO: 236 - protein, 1062 aa, Unknown; identical to SEQ ID NO: 81
  Description of Unknown: uncultivated organism with predicted taxonomy: Verrucomicrobia
  MG1-241 effector

SEQ ID NO: 237 - protein, 1062 aa, Unknown
  Description of Unknown: uncultivated organism with predicted taxonomy: Coraliomargarita sp. CAG:312
  MG1-242 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 238 - protein, 1074 aa, Unknown; identical to SEQ ID NO: 151
  Description of Unknown: uncultivated organism with predicted taxonomy: Verrucomicrobia
  MG1-243 effector

SEQ ID NO: 239 - protein, 1059 aa, Unknown; identical to SEQ ID NO: 96
  Description of Unknown: uncultivated organism with predicted taxonomy: unclassified Verrucomicrobia (miscellaneous)
  MG1-244 effector

SEQ ID NO: 240 - protein, 1062 aa, Unknown; identical to SEQ ID NO: 97
  Description of Unknown: uncultivated organism with predicted taxonomy: Coraliomargarita sp. CAG:312
  MG1-245 effector

SEQ ID NO: 241 - protein, 1061 aa, Unknown
  Description of Unknown: uncultivated organism with predicted taxonomy: unclassified Verrucomicrobia (miscellaneous)
  MG1-246 effector
MKVMEAENRNHIWGFDIGKGSLGEAVLMGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPTEFYAKKAGEISNADPNKGIVASDLDFIKLMGNCGWSGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKIGNTYNDKGELLLHEGVYMVNTIQTDGRGKLTNPNGEKSNLININYLMKAGMRKVSVKDL

SEQ ID NO: 242 - protein, 1062 aa, Unknown
  Description of Unknown: uncultivated organism with predicted taxonomy: Coraliomargarita sp. CAG:312
  MG1-247 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 243 - protein, 1034 aa, Unknown; identical to SEQ ID NO: 147
  Description of Unknown: uncultivated organism with predicted taxonomy: unclassified Verrucomicrobia (miscellaneous)
  MG1-248 effector

SEQ ID NO: 244 - protein, 1059 aa, Unknown; identical to SEQ ID NO: 149
  Description of Unknown: uncultivated organism with predicted taxonomy: unclassified Verrucomicrobia (miscellaneous)
  MG1-249 effector

SEQ ID NO: 245 - protein, 1062 aa, Unknown; identical to SEQ ID NO: 158
  Description of Unknown: uncultivated organism with predicted taxonomy: Coraliomargarita sp. CAG:312
  MG1-250 effector

SEQ ID NO: 246 - protein, 1062 aa, Unknown; identical to SEQ ID NO: 184
  Description of Unknown: uncultivated organism with predicted taxonomy: Coraliomargarita sp. CAG:312
  MG1-251 effector

SEQ ID NO: 247 - protein, 1060 aa, Unknown; identical to SEQ ID NO: 139
  Description of Unknown: uncultivated organism with predicted taxonomy: unclassified Verrucomicrobia (miscellaneous)
  MG1-252 effector

SEQ ID NO: 248 - protein, 1059 aa, Unknown
  Description of Unknown: uncultivated organism with predicted taxonomy: unclassified Verrucomicrobia (miscellaneous)
  MG1-253 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGREISEISNTDKNKGVVSSDLDFIKLMGDCPWGGIFIPADLTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 249 - protein, 1059 aa, Unknown; identical to SEQ ID NO: 136
  Description of Unknown: uncultivated organism with predicted taxonomy: unclassified Verrucomicrobia (miscellaneous)
  MG1-254 effector

SEQ ID NO: 250 - protein, 1059 aa, Unknown; identical to SEQ ID NO: 134
  Description of Unknown: uncultivated organism with predicted taxonomy: unclassified Verrucomicrobia (miscellaneous)
  MG1-255 effector

SEQ ID NO: 251 - protein, 1059 aa, Unknown; identical to SEQ ID NO: 119
  Description of Unknown: uncultivated organism with predicted taxonomy: unclassified Verrucomicrobia (miscellaneous)
  MG1-256 effector

SEQ ID NO: 252 - protein, 1059 aa, Unknown; identical to SEQ ID NO: 143
  Description of Unknown: uncultivated organism with predicted taxonomy: unclassified Verrucomicrobia (miscellaneous)
  MG1-257 effector

SEQ ID NO: 253 - protein, 1074 aa, Unknown; identical to SEQ ID NO: 157
  Description of Unknown: uncultivated organism with predicted taxonomy: Verrucomicrobia
  MG1-258 effector

SEQ ID NO: 254 - protein, 1059 aa, Unknown; identical to SEQ ID NO: 161
  Description of Unknown: uncultivated organism with predicted taxonomy: unclassified Verrucomicrobia (miscellaneous)
  MG1-259 effector

SEQ ID NO: 255 - protein, 1059 aa, Unknown
  Description of Unknown: uncultivated organism with predicted taxonomy: unclassified Verrucomicrobia (miscellaneous)
  MG1-260 effector
MEKEKNNHVWGFDIGKGSLGEAVRIGGDFKHIASVLLDPEFGEIKTAALACRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 256 - protein, 1059 aa, Unknown; identical to SEQ ID NO: 94
  Description of Unknown: uncultivated organism with predicted taxonomy: unclassified Verrucomicrobia (miscellaneous)
  MG1-261 effector

SEQ ID NO: 257 - protein, 1061 aa, Unknown
  Description of Unknown: uncultivated organism with predicted taxonomy: unclassified Verrucomicrobia (miscellaneous)
  MG1-262 effector
MKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYYVLPIYVHASKAKLPAELCANPKKKRICGIFTSHCMVKVGNTYNNKGELLLPEGVYMLNTIRTDGWIQLTSANGDKSKPININYLMKAGMKKVPVKDL

SEQ ID NO: 258 - protein, 1055 aa, Unknown; identical to SEQ ID NO: 153
  Description of Unknown: uncultivated organism with predicted taxonomy: Verrucomicrobia
  MG1-263 effector

SEQ ID NO: 259 - protein, 1075 aa, Unknown
  Description of Unknown: uncultivated organism with predicted taxonomy: unclassified Verrucomicrobia (miscellaneous)
  MG1-264 effector
MSLYFIEQISDWKIMKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 260 - protein, 1063 aa, Unknown; identical to SEQ ID NO: 159
  Description of Unknown: uncultivated organism with predicted taxonomy: unclassified Verrucomicrobia (miscellaneous)
  MG1-265 effector

SEQ ID NO: 261 - protein, 1022 aa, Unknown
  Description of Unknown: uncultivated organism with predicted taxonomy: Coraliomargarita sp. CAG:312
  MG1-266 effector
NNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMIN

SEQ ID NO: 262 - protein, 1073 aa, Unknown
  Description of Unknown: uncultivated organism with predicted taxonomy: Verrucomicrobia
  MG1-267 effector
MHTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATELGKIANTDKNKGLVAGDLDFLKLMSDAPWSGIFIPDVGLSDFADTSEAARAAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWHSLKGAEWDSYCDRVRELTKNLGAKRCRLLLAPNAAELVEKYTALAETAWISKLAQRICCLHFGFQFGGLAGAKKVWTVSGNTTAMIRGRYGLNRLLHDEEAAEDLSLFDRICMEKKFEEKNRKNKKHHALDAMCLCFAPTSNAKKASAYKNILPEEITRNPESDEARKFFGRYLATVIPNKVAVEKSKLEQTIYSLRKGRIVKKCNVRDLAYEGINPKYNYTKLVKRIESIVGDVSKRIISDFVLSNPDLKESEWEDWCKYEAAIPSKNGAPTKLLRVLCEVGSPEEYKDLSKDGCGAYRKGDSHKGQFIWKTQKGKYMVAPVYAYASKAKVFAALKSNPDCAEVCGFFRQNCLVEISNDVIDKSGKMLLKSGIYKSNTIMSDGRAKFTNSDGISTNPISIQYLMPAGMKRIKLDTV

SEQ ID NO: 263 - protein, 1059 aa, Unknown; identical to SEQ ID NO: 100
  Description of Unknown: uncultivated organism with predicted taxonomy: Verrucomicrobia
  MG1-268 effector

SEQ ID NO: 264 - protein, 1078 aa, Unknown
  Description of Unknown: uncultivated organism with predicted taxonomy: unclassified Verrucomicrobia (miscellaneous)
  MG1-269 effector
VDFCSHCKYFNNNKEFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPELKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 265 - protein, 1055 aa, Unknown; identical to SEQ ID NO: 98
  Description of Unknown: uncultivated organism with predicted taxonomy: Verrucomicrobia
  MG1-270 effector

SEQ ID NO: 266 - protein, 1059 aa, Unknown
  Description of Unknown: uncultivated organism with predicted taxonomy: unclassified Verrucomicrobia (miscellaneous)
  MG1-271 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLFNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVDDVYNDKGDFILPAGRYMVNTIRSDNQCVLTNADGEKRNPININYLMRAGMRRVDLSEL

SEQ ID NO: 267 - protein, 1273 aa, Unknown
  Description of Unknown: uncultivated organism
  MG1-272 effector
MKDYVLKAANQSPTNNDSFLTGLVFGFDVGTGSIGYAVRKKDKFLDAGVLICPEGINDLSGRNGLRRGRRTLDHRQNRRDWFAENLAKVLGLSLHKGTRLPNTAWTQNEKAGWIPVSPKFANPVSLRIDALGGKPLTAEQLFTALAHLIKHRGPSEKVPWSKTIAEEQRDLDEKESVSDTIPADQVRAEFEKARKEFTLSNADASGFHPAHYLQQLGEERKLQRKRAWPRDLVETEAAAILEAQANHHQKLKEEIKFVDVSGENRKATVAEWLLHGNSSIKSVREGDAEMSFHVFDRNYPNRERAPFTFQAARIHNRKPGLDLVEPRDEFGRPRYVMSRERPEYGQWQVEVALLNFKVLDLTSLKKDKAKIVPSAEALAELREIITRTGRLSVEDLQTWIKPYKENGIYDLVKEQPALVGEGKGRGRFSRVGLQRATEIIRPLQTEHNAMSKLTPKGQRAKKKLKTPEDKADAYVRQYVNYTPKLRYAWKNPATQITEPEPLPRALRRYILEIRDPVVRHRVELFDRMLDDLLGKYRSDGNPTHIVIECVRELEQDAEAAQDAWERRKKDREENQTARATLKDMGVKAPTDKDVRKFRLLQECKWRCPYTLERFMQTEFDDLVIQRIVPPAGDPRRSAYLEAARSAMQGTQVEHMVPQAAIVCDEWFNVTVTRPTTNTTKGDRTPYDFVLRDGDKDRRKQLLENAEQCFGKDSLKFKIFSSDNARSLIQERDKLQRTAYIARCLRYVCLLKFGWLSPEDRDPGHEKANDATRSYLVTNGGTTRRLRQAWNLDELLRETVSPEKWAGMTDVEKERALAQGARIPTEEWKKLDKAKQDDVLRARRTKNRQDVRHHALDAMVVACTLPWAANLTVWASGWCNLDTDDGSVSSVRCPIFGENDFGEGIYAAIEAKLSELKTALPEATSNAITHYRSHERHKQVFDSGLYGKRTTYGGKPLEKDEPVFFVIAKQLSRLTPAVLSYPAKGGGDSIFSPKLREHIASAWKTYTADNANWQHLLTRSEEDLQRELQDAENSKDNQYKFKTIKALKDRLRRVSQWRVAIPNETLWAELQEYLQQEKARRLKKPEARNNVFPDHFIEGLRHPNYNTPIHSVKVIALTKDEDAYVELRTGSKTFWKYKGGYEAMRVYGSPPKTRTGKGKFICWLVRRFYKRKKKENGQLQTVKEAHAAAMPAVCQGQKLLATFHNGQVVRFKQLAKDMDISHNWIICETNADTRNPRNSKIVVMPAHLAKIVADPENPKRTISLKETEGVPLFL

SEQ ID NO: 268 - protein, 992 aa, Unknown
  Description of Unknown: uncultivated organism with predicted taxonomy: Rhizobiales
  MG1-273 effector
MDKTDYVLKNKPEPASNDKFLTGLVFGFDVGTGSIGYAVRKGSEFKDVGVLICDSEGSELEGRRNLRRQRRTIRSRKSRREWFARELVKLGLPKSETALDDPISLRLRALNGEVLKPEELHAALTHLFKRRGYTKVPWANVEAVRKDGEKAKKEEGDTQKAISELEQEMKNAGCDYPCQLLDQRRKKLGERPQTKWGRNFPWGRATLEKEFWKIVEAQKEHCPELAKNAEKLLHGNTHKVTRIIDGQKREFHVYFKTDKEHKAGVLGVRWPKFENRSPGLDALEPFRKDPKTGAWIPQHTMRRDNLLFKEWQLEKSLHDFRVKRRMISSGRSKKEKFEFIPPPPAALAALRKLWNERGHLWAADLQEWAKAYEGQFELHYPDRDLTPRNNFSGRARFSKIGMASIRKVIDEARVRHDVAYEAWELKFKEKNKEAKEEDIFNGYARFLTQQSNAPVLAAGVADNSYARTVAPPPVLILPGETPEAAFQRYLNAIRDPQVRHRVELFGRELRRLMTLHSQNQAPDFIVIEMARDLMMNQEQKDAKEAKDKERRKERDEAAQILRDMGFAPDADNIKKFLLAQEAGWRCPFTLRPFCQSDFSQLTVTQLIQAENKPRFVKEASSVFDRLEIEHLVPRTPVVCNEWFNLTVTLHSTNAQKRKRTPFQWLFADKDGLPADLDWERIRKNAVERFGESSLKYQVFTSPDGAKLVEDNAKKSIQQTAYIARCLREACLIIFGKEWLDWTDGAGRDPRLLTDNRASKNYLTTNGVITSRLRGAWHLNEVLWPKPERLNDTEWDKLTDDEKIPLKAKYKEERELRALKNRQDHRHHAIDAMVISCAMPWQTCKTRTGSQQSDDGLCEVDSETGAITKIWNPVFNDYGYGIKQAAEAKSALLLKFSSERQVDLLRHHKSNNRNAQAFDTTIYGRRENFGGEILPQTLFVARKRLLDLKVSHLDPRGKGGFIFSKLLRDHIEKEWKLFSGDEKNWLRVQSDWM

SEQ ID NO: 269 - protein, 1258 aa, Unknown
  Description of Unknown: uncultivated organism
  MG1-274 effector
MPKENESSFLNGLVFGFDVGTGSIGYAVRKGAEFLDVGVLICDSKGSDLSKRRELRRQRRTLRSRKYRRQWLANELSELGLTKPVPSPDDPVSLRLRALNGEALKPEELHAALTHLFKRRGYSKVPWAKVEALRKNGEKAKQEDSDTQKGITELEQEMNEKGCTYPCQLLDLRRKDAGTLPKRKWGRNFPWGRQMLETEFRAIAEAQKDHFPELVQNVESLLHRNTLEIRREVDGKKQTFHVFFKTDTGKKPGVLGIRWPKFENRGPGLDALEPFRKDRKTGAWIPQHTLRRDSLFFKEWQSEVALRNFRVKRRLITVGRSKKEKFELIPPPPVALERLRNLWNEHGHLWAEDLREWAKNYEGQFELRDPDFNLTPRNDFSGRARFSKNGMAAIRQIIANAREKHDAAYNTWEQRFKDKNLKANEEDIANGYARFLTQLTNEAASNQATADNSYARTVAPPPVLILPGETTDGAFQRYLNSIRNPQVRHRVELFGRELQRLMNLHSEDQAPDFIIIEMARDLMMNQKQKDAKEAKDRERRDERDKAAQILRDMGYAPTADNIKKFLLAQEVGWRCPFTLQAFCQSDFSRLTITQLAQAENKPRFLKEASSVFRRLEVEHLVPRTPVVCNEWYNLTVTLHSTNAQKGKRTPFQWLSIDKDGVPPDLDWDCACKNAADRFGANSLKYQIFTSPNAAEIIADNAKRSIQQTAYIARCLREACLIHFGKEWLDWTDGAGRDPRLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNAQAFDTTPYGRREKFGGDELGQPLFVARKRILDLKTSHLNPRNTGGFIFSPLIRDHIAKEWESFSGNEKNWIRIESDWIAIFEAQIATLRASGKDDQKTRLGIKARESRIYKLRQMEGCKDWEELLSFIAKELGAQQPQPKFPSQFIETLCHPIYKTPITSVKVTAQSKNDESFSLVRRPTSEKARSGTYVMRKQEDKYREMRVYRLPKPGRSGAYACWLLLPWYGMLDARGKRFKTVEKDLMTRACKGAKFVRAFRRDDIVCFANNLLANKGIKQNESWRIVRTDAKGDCLANVGLLPANLARETSHPITGEKVKLEPVVVALNDFMNALEPRLPTDELSHSPPVKPKSPGAAET

SEQ ID NO: 270 - protein, 1260 aa, Unknown
  Description of Unknown: uncultivated organism
  MG1-275 effector
VLISAQWKTISTNLSIMDYIIKPAPGSTSSPYDWANDPFYKSAIVLGIDIGIEGIGVWLRKGRNHVFARTFLFNTPEAAPLKGRRLLRGGRRCRQSEQHREVLLKQFCAEFGLPWTEIKDQENEDGPFKLRLRAVRSKLGSKEALVVCLRHIIRHRGYDYHETDGGSFPWGDELKADVATGWAKAAYCSPEDAAEFLHDVSDCGWNDKQLASFRHALTAAVERHKQGIEAALEKHFAQDKNNLRIPARKHNFPRSLIWKHMEKICANHRDFLGGEAGLSAALLKLKPILNYHRKKPGALAERKVNRCPVAIHLFGGTAPKCDPNSNPHIRRFKLLEFLATRSFVAKDGTRLLANADLMKWLLDEVLAEDIRAVVVNKVKGGQKQERRKFGGFRDEFIARFDPNGKIELAGDRVSHNKDFFEQLGDLLRPKLSVLNARASICGKSAEELFKRATKDGYQAEIISRNLKEKQFDGQSFYTLRQAAAAGFGIYPQVEFLLGRRGKKGNQAVPGVLRQMLELPEVSAKLDGQKIPDYVIIETVGDMPRNVVQAKEIQDEQKRRREFKEGLFEKFGVHDKQQDSEARKRVLLYDQQGGNRGEAICPYTGEPLGDPLSPKLQIDHIFPESLGGISEMVNLVLTHETTNNQRKGNQTPYQAFGGQQNTAEWQALVARVQKMGWNKQKRELVLREESSCPEWDNMTRIAQLARQLREEAARWLGVFGDDAKVRQKIGTPTGYQTSVCREAWSENVPKKDRTNLRHHLWDAAVISHIPPDRGMQLSHCGGIFFHAGEKKNGNILMRALPGLGPDLNSFENATKDQCLVEKKKTNRSKKSRFQQWIYGFPDKNGQMWARDSLKSLADKANLLELLRDAGIGENQLPTSHFEEWQEKRKAQFFTREEAWAAVEALALPPEQKIPEPIFEEWWSYRFSGDKRKVDEKLLRILIAKAGVKESVSKERLASVLTNRGDPGPLTRKDGTPINGVSGTAKQMTPMAIIPHRNHKREIIGFKLATESFVRAEIWVTEKPTKDGNAELNYHCRLIPHPRGLANLRQRVMQCTGKQLTWERRLTDEELRELGLLKELAALKREQEKISATHAKAVQKWQKEQQAKTNTLDLASSPSVQPIELKLPWLSLRKCYAGLPLYARRLTNKHGADISRIAKDDLLRVPLNSEGDICKREESAYQTLWYRVSAINKSGKIEMKMAERKQIKPPSERELRDGKRKPLTTDELWRVYAYTKEPSSTDVLAYLLEITRGNDQPPHPVK

SEQ ID NO: 271 - protein, 780 aa, Unknown
  Description of Unknown: uncultivated organism with predicted taxonomy: Verrucomicrobia bacterium IMCC26134
  MG1-276 effector
LFGPPARAYASFFVEERKRHGLREGSASDWQGVLSQKIPRFDNRIIGKCVLIPRLNVCKIRTGPDGGLLPQSRVAAEVVFLMKLKNMRLHRDGGARGLTAAEIGKILGDPKRSKLGLTPTQWKKWCVRFGGLPLPGQYEEVEEPRFSGRSRFCRPALEILRRLILSGDAPPLAHEKEVARLNGNTDPLKGLVPDDLRFLKQMGSTWEGIYVPNQKLDALARLTDDPQEAIRRLIGSQNDPIVRHRLALFAKRLDYLAVTKKFGPPDYVVLEFVREDFMGQKAKLEYLKFQRERARARAEAREEAAKAGATENSAGLKMELHKAQGGICLYTGDGLAVTSLDDYDIDHIVPESQGGPDALLNKVLTTRLANREKANRTPYEWLASSDRWDAYVERGKKRLTTLRNKKVQLLTSPEATALVEKYTALAETAWISKLAQTIVGLRFGWPGGIVDGKRKVIVVSGGLTGRIRRKYKLNRLLNPNASSEEEAETKNRDDDRHHALDAMVISFIPNWTRNAKLAGFFRFPEGVHGEFFANEIADVVPKNVALEKAAFEETCYGRRTLQGEQFAVGREDLSGLAVRLVGAKRVLKKRADIETHRIVDARIRSDVEAFLDANVGLTLEAWGAWCSTYKQGGNGPRVAKVMVTKSKADSLEEYKDVSKDGTGQLRRGAKHRGYFVYEHLAATKKDPDRKQLEVRPVYVHESKKAVAAGITGRIYAYFESGCLVRLAKPWVFQGKPYPPGQYICTSIWANRNAKLRHPEYGDIGPVGLRLLLDAGFERVE

SEQ ID NO: 272 - protein, 1068 aa, Unknown
  Description of Unknown: uncultivated organism
  MG1-277 effector
MKDYVLKNKPEPASNDKFLTGLVFGFDVGTGSIGYAVRRGADFKDVGVLICDSEGSDLSKRRDLRRQRRTLRSKKFRRQWFAKELAKLGLPKSQTALDDPISLRLRALNGEALKPEELHAALTHLFKRRGYSAVPWAKETKETVKPKTEDDDGEILKQAHGLKAEMDKRGCKHPCQYLAQRRKEVGESPTDYWGRKLYWLRELLEAEFRAITEAQQKYFPQLAEKSDWLLYGDSQPKKTKDEETFHVFFKATEARSPGVLGLRWPRFDNRGPALDSLQPVDEQGRTQHVVRKNKEAFTKAQWELALMNFRVIDRASGKLVAPDRKSLVRLREIWESGKRKKKKESASDTEESETIKISEPVLKRWAKDFVGQYKLVDGQQPLTPQTGAGRARYSSPTLERIIAGEQFNPPQPLLRRKNESPEQALNRYMTDIKHPLVRHRLILFQRLLKKLVSQFGEPDTIVMEAVRSLALGKTKKRELIQRIHNNREERDGIRKELSKDGFSSSKNSILRYRLFKEAKGRCPFCLCPFCLQAVLFKEAEIEHIVPRSRVDCNEFYNLTVAHADCNKKKDNRTPWEAFGQTPDWEALRRNAEECFGLGSMKYKLFTNPDAQDLVEEKSDLQHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKRQFFDTTRYGKRGKDLFIARKVLAKMNPKQLAKIYPESQSLYLTEAWNRFTAENPNVDLLLKEENRGKEQGAKVALPGKFISRLCFSEYQRWVESQKTSAPLGFRWPERVKIPFKSVSVIADDGDSAMFETKLGSKTYVSQTEFKEVRVFLPPNGKKFITQFVRPWVRKGIAEQSSIPEGSKHICTLTKGDILVMKNADLEKKIEAGTRWILKKTFSSGRVSILPSHLSPNREVLISLGFDPINFLRISMNDLMRVLGHELPHPPSVKPQSESSD

SEQ ID NO: 273 - protein, 788 aa, Unknown
  Description of Unknown: uncultivated organism with predicted taxonomy: Pedosphaera sp. Tous-C6FEB
  MG1-278 effector
MKSAKPQPMKTIWAFDLGKGSIGEAVRLDDKFPHAESLLIPAELARRGPATVSGTPANRYRALKTREAHHERERWLETVWKSAGLIPLYPREVWENPNTGKWELKRNGDHRLEREFAPKLGEKTKDGAPSDEAGAEVCYTSCLLRINLLQGNKLADWQIFKALRAALQCRGYGPVPWATKEARKQGRTAEEIQLEEEKKLQQADARYRDAVGKWPEFKRSVPAQFHFACYYDASKIGLWDVSNPNIFLHRANHLAASTRNVRFDRVDVRAEMIKLGDQAAAILPELRIAFARWQKDGWKFRHPNGKELTYPVRAKTFGEFLCDGPAGKPDETSFEAFLSQRRDVKVQRGSYEEWMAALGQKTPSFDNRILNICVLIPRFHVCKVDVRLETQKDENKKDKFTGNIVPESLLASEVTFLLKLKNLLVADGQRKLTAGEIQFVFNYAHRQLKELKLVTPGGELIKNWPGKIADCFALSKSEWGGKKSLSKLALRPLPGHEEVKAPKTSGRSAYSRVALRILKELILSGEAPSVFHAKLLRRDADLLRRLGSNSDRPLVLFDDSVAKDEKQRERENNENRKHVVLVSEVHFLCQMRKDNSAADSWENIFIPSQTLDALQQRHTNDGKLDADDAIQELLGTINDPIVRHRLGVFAGRLKKLQHGDGKEETPKCGVPDFIVLEFAREDFMGEEAVKKYQRFLNDRADERKKAREEAEKLGLESRSSGLRYELFKAQGGICLYTGKSLGETSLDDYEIDHIVPRSLGVPDAALNYVLTFHDVNHAKEKGKLTPYA

SEQ ID NO: 274 - protein, 1024 aa, Unknown
  Description of Unknown: uncultivated organism
  MG1-279 effector
MKDYVLKNKPEPASNDKFLTGLVFGFDVGTGSIGYAVRKGADFKDVGVLICDSEGSDLSKRRDLRRQRRTLRSKRFRRQWFAKELVKLGLPKSETALDDPISLRLRALNGEELKPEELHAALTHLFKRRGYSKVPWANEAKIVKETAKSKKDDDEGIIKEAVKEMKAKLGDKHPCQFLAEEKARVGNSPTTNWARKIYWPREVLRAEFLAILKAQQNNFPQLAEKADWLLYGDSQAKEKNGETFHVFFKSTEARNPGVLGLRWPRFDNRGPALDSLQPVDGQGRPLHVVRKNKEAFGNAQWELALMNFRVLDVETRQKRDPRTDFPIFIENVRNEWNKKGKVTEARLKTLAKPFKDKFLLIKDQKPLTPDHGGGRARYSSPTLDLIHKEISEGRRVDPPQPILQRKGENAEQALNRYLADVKHPVVQHRLVLFRRLLMQLVSRYGQPDMIVLEAVRSLALGQKAKNELNQRNEKFRKERENAREQLSSNKESFSRKAIQRYRLWQEAKGRCPFCLQMIERTELGHGADIEHLVPRSIVDCNEFYNLTVAHIKCNRELKGDRTPFAAFSGTSQWPDIKDHAEKTFFGRKLEIFLSPDAEQLIEQKSDLQHTAYIARVIRHISLIQLGWLNDAGRDPTPEKQNPALSFQVTNGQLTSRLRKSWGLNQILHPLPPGKRWDELTDEEQTQFTEKNRGDLRHHSLDAMVIACTLPWLAHRTHGATDQFGHHGWWTQDEKQRSKAANPLFPNEGQMHDVVKKEIEKVIVRHHVSRSNHKRTYDTTIYGKKSSNVYVAREKLTDLKEKDFESVYPKIFGVYIAAAWERFTTETPGLPEMLKATKNKLPEMFARKLCFSHFQNWREKKPVAFDWPDKVRIPIRSVKYIGVHDDKAVAKASSGTHGYVARGGYKEVRIHKTTDGKGWVPVFVPYWKGDRLIHEQPFQAEKPVQTIRLGDLIELKNGYGPNNPPGTYRVVSTMQKQIQLMPPNIADTKEALKASGYLENGINLRWPAFFKAAGYELPHPPSVKP

SEQ ID NO: 275 - protein, 1214 aa, Unknown
  Description of Unknown: uncultivated organism
  MG1-280 effector
KVLGLSLHKGTRLPNTAWTQNEKAGWIPVSPKFANPVSLRIDALGGKPLTAEQLFTALAHLIKHRGPSEKVPWSKTIAEEQRDLDEKESVSDTIPADQVRAEFEKARKEFTLSNADASGFHPAHYLQQLGEERKLQRKRAWPRDLVETEAAAILEAQANHHQKLKEEIKFVDVSGENRKATVAEWLLHGNSSIKSVREGDAEMSFHVFDRNYPNRERAPFTFQAARIHNRKPGLDLVEPRDEFGRPRYVMSRERPEYGQWQVEVALLNFKVLDLTSLKKDKAKIVPSAEALAELREIITRTGRLSVEDLQTWIKPYKENGIYDLVKEQPALVGEGKGRGRFSRVGLQRATEIIRPLQTEHNAMSKLTPKGQRAKKKLKTPEDKADAYVRQYVNYTPKLRYAWKNPATQITEPEPLPRALRRYILEIRDPVVRHRVELFDRMLDDLLGKYRSDGNPTHIVIECVRELEQDAEAAQDAWERRKKDREENQTARATLKDMGVKAPTDKDVRKFRLLQECKWRCPYTLERFMQTEFDDLVIQRIVPPAGDPRRSAYLEAARSAMQGTQVEHMVPQAAIVCDEWFNVTVTRPTTNTTKGDRTPYDFVLRDGDKDRRKQLLENAEQCFGKDSLKFKIFSSDNARSLIQERDKLQRTAYIARCLRYVCLLKFGWLSPEDRDPGHEKANDATRSYLVTNGGTTRRLRQAWNLDELLRETVSPEKWAGMTDVEKERALAQGARIPTEEWKKLDKAKQDDVLRARRTKNRQDVRHHALDAMVVACTLPWAANLTVWASGWCNLDTDDGSVSSVRCPIFGENDFGEGIYAAIEAKLSELKTALPEATSNAITHYRSHERHKQVFDSGLYGKRTTYGGKPLEKDEPVFFVIAKQLSRLTPAVLSYPAKGGGDSIFSPKLREHIASAWKTYTADNANWQHLLTRSEEDLQRELQDAENSKDNQYKFKTIKALKDRLRRVSQWRVAIPNETLWAELQEYLQQEKARRLKKPEARNNVFPDHFIEGLRHPNYNTPIHSVKVIALTKDEDAYVELRTGSKTFWKYKGGYEAMRVYGSPPKTRTGKGKFICWLVRRFYKRKKKENGQLQTVKEAHAAAMPAVCQGQKLLATFHNGQVVRFKQLAKDMDISHNWIICETNADTRNPRNSKIVVMPAHLAKIVADPENPKRTISLKETEGVPLFLNEFMWALGYETPTKDNELPHPTSVKPQS

SEQ ID NO: 276 - protein, 837 aa, Unknown
  Description of Unknown: uncultivated organism with predicted taxonomy: Thermoflexibacter ruber
  MG1-281 effector
ESPTDYWGRKLYWLRELLEAEFRAITEAQQKYFPQLAEKSDWLLYGDSQPKKTKDEETFHVFFKATEARSPGVLGLRWPRFDNPGPALDSLQPVDEQGRTQHVVRKNKEAFTKAQWELALMNFRVIDRASGKLVAPDRKSLVRLREIWESGKRKKKKESASDTEESETIKISEPVLKRWAKDFVGQYKLVDGQQPLTPQTGAGRARYSSPTLERIIAGEQFNPPQPLLRRKNESPEQALNRYMTDIKHPLVRHRLILFQRLLKKLVSQFGEPDTIVMEAVRSLALGKTKKRELIQRIHNNREERDGIRKELSKDGFSSSKNSILRYRLFKEAKGRCPFCLCPFCLQAVLFKEAEIEHIVPRSRVDCNEFYNLTVAHADCNKKKDNRTPWEAFGQTPDWEALRRNAEECFGLGSMKYKLFTNPDAQDLVEEKSDLQHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKRQFFDTTRYGKRGKDLFIARKVLAKMNPKQLAKIYPESQSLYLTEAWNRFTAENPNVDLLLKEENRGKEQGAKVALPGKFISRLCFSEYQRWVESQKTSAPLGFRWPERVKIPFKSVSVIADDGDSAMFETKLGSKTYVSQTEFKEVRVFLPPNGKKFITQFVRPWVRKGIAEQSSIPEGSKHICTLTKGDILVMKNADLEKKIEAGTRWILKKTFSSGRVSILPSHLSP

SEQ ID NO: 277 - protein, 947 aa, Unknown
  Description of Unknown: uncultivated organism
  MG1-282 effector
MKDYVLKNKPEPASNDKFLTGLVFGFDVGTGSIGYAVRRGADFKDVGVLICDSEGSDLSKRRDLRRQRRTLRSKKFRRQWFAKELAKLGLPKSQTALDDPISLRLRALNGEALKPEELHAALTHLFKRRGYSAVPWAKETKETVKPKTEDDDGEILKQAHGLKAEMDKRGCKHPCQYLAQRRKEVGESPTDYWGRKLYWLRELLEAEFRAITEAQQKYFPQLAEKSDWLLYGDSQPKKTKDEETFHVFFKATEARSPGVLGLRWPRFDNRGPALDSLQPVDEQGRTQHVVRKNKEAFTKAQWELALMNFRVIDRASGKLVAPDRKSLVRLREIWESGKRKKKKESASDTEESETIKISEPVLKRWAKDFVGQYKLVDGQQPLTPQTGAGRARYSSPTLERIIAGEQFNPPQPLLRRKNESPEQALNRYMTDIKHPLVRHRLILFQRLLKKLVSQFGEPDTIVMEAVRSLALGKTKKRELIQRIHNNREERDGIRKELSKDGFSSSKNSILRYRLFKEAKGRCPFCLCPFCLQAVLFKEAEIEHIVPRSRVDCNEFYNLTVAHADCNKKKDNRTPWEAFGQTPDWEALRRNAEECFGLGSMKYKLFTNPDAQDLVEEKSDLQHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKRQFFDTTRYGKRGKDLFIARKVLAKMNPKQLAKIYPESQSLYLTEAWNRFTAENPNVDLLLKEENRGKEQGAKVALPGKFISRLCFSEYQRWVESQKTSAPLGFRWPERVKIPFKSVSVIADDGDSAMFETKLGSKTYVSQTEFKEVRVFLPPN

SEQ ID NO: 278 - protein, 1319 aa, Unknown
  Description of Unknown: uncultivated organism with predicted taxonomy: Verrucomicrobia bacterium IMCC26134
  MG1-283 effector
MDKTNYVLKNKPEPAANETVWAFDLGKGSIGEAVRRGNEFLHKASLLIPAELARRGPAKVSGTPANRHRALKTREAHYERERWLETVWRTAKVTSLLTPLRPREVWENPETHKWELKHPADYQLEREFAPAEFRRNSKTGEKEKIVYPNGHAENDGAPASTSEDFNLCYTSCLLRIKLLNGDSDLKAWQIYKALRAAIQCRGYGKVPWAAKEARKQGKTAEELELEEEKKLLQADPRYREAVGRWPDFKRSIQKLKLPLFDGMQPRKADNFYFVPPCYYDASKMGLWNPSAPDKLLSHSNLANSTRNVRFDRFDVRNELIMLGDQAAALLPEIRDAFARWQREGWKIKHPVTGKELTYPVHAKTFGEFFCDGPAGKPDETSFEAFLNQREKAGLHRGSFEEWMAALGQKTPSFDNRILNDCTLIPRFHVCKVDLKLETAKHGEITGKILSESLLASEVTLLLKLKNLLISDPVNGQRKLTVEEVRDVFAYAQRQLKALNLIAADGDLIKGWPEKVADRFALNNSDWEKIAAEAEFFRKMSAFNLSQGGENRRLTEVEIYSLLRAAADSKRKLEHELPDNLKTLFKAAKAEWKKAKVVADTTMLRPLTNHEIVKAPKTSGRSGYSRVALRIIKELILSGQAPSVFHARLLRRESKLLGKLGASPAKPLCLFADSTATSEEQRKKEDTENRKRGLLESELNFLLQMRKDDATEDSWKDISPPSQTIDALQQRHTKGNKLDADAAISELLGSINDPIVRHRLEVFDKRLKKFELGDVKESIPAFGVPDAIVLEFVREDFMGEKAKRELKDFQDKREAARKKAREKATAAGSEEKSAALKFELCEAQGFICLYCGQPFATTKLNECRIEHIVPTAQGGPDAMVNYVAAHDECNEAKGKQTPFQWWHHNTSGKAPTISWDGYKALVDKYATTLRNKKVQLLTREDAVELVGRYTALAETAWVSKLAQTIANLRFNWTNGYDQNRKKRVIVISGGVTARVRRKYGLDKLLYNKDTDAEVFAKKLKNRADKRHHALDAMVLTFVPQWARDPGKEGFFRFPAEFRDANGREDYEQIRKLFGDSIAKVMPRYLTYERPVLRDRAYGQRDNKTMMVQRTPLRELAYKPVQQKLVYDLTYAVDQIKDVRDERIKQELQKFIAASPEEPAWNVFCDRLGKGELESLPGIKVSKVSQNLNGDLSEYKDMSKDGCGAFRRRKERHRGQFVYLDEKGKPRVEVVRVFDSIAKVKTELGAKGQGIKIIGFFQSDCLVKIGKPVAHGTITLAPGTYQLNKIVKEGQGRVQVTSAGGEKSPAISLSKFLEAGFERVD

SEQ ID NO: 279 - protein, 1053 aa, Unknown
  Description of Unknown: uncultivated organism
  MG1-284 effector
MKFNISTNTDPFLTGLVFGFDVGTGSIGYAVRRGSTFLPDGVGVLICDSEGSKLDERRNFRRQRRTLRSKKFRRQWFAKELVKLGLPKPTKEQLKRANNETNEQFDQRTNPVSLRVRALNEPLEKWQLFIALTHLFKRRGYEKDVPWANKEKDTKANKENDAEEWGSGTVPPEKVQSEFDASGCKYPCEFLARNPKHQRRRVWPRVLLENEFHAIAKAQTENKNFPQLTEKTNWLLYGETKEVKGHHVYFKTTEAQNPGVLGLRWPRFDNRGPALDSLQPLDEQGRPLHVVRKNKETFRKAQWELALINFRVIDRATGNLVRPDDKSLTRLREIWESGKRKKKKESGSNAAESEIIKISEPVLKRWAKDFAGQYKLVDGQQPLTPQTGAGRARYSSPTLERIIAGEQFNPPQPLLRRKNESAEQALNRYMADIKHPLVRHRLTLFQKLLQQLVSRFGEPDMIVLEAIRSLAMGEKKRREHIQRIKENRDERESIRTELKKDNFSSSKNSILRYRLFKEAKGRCPFCLCPFCLQEVVYKEAEIEHIVPRSRVDCNEFYNLTVAHQECNKKKDSRTPWEAYGTTKDWEALRKNAEDCFGLGSLKYRLFTNPDAQNLVEEKSDLQHTAYIARVIRQVSLIQLGWLAEDGRDATGLKDPEMTAWRFQVTNGSLTSRLRKSWGLNQILNPFPSKDAWEAMTPEEQEKKKTEMQEKNRGDLRHHSLDAMVIACTLPWLAHRTHGAKDSFGRPGWWWLDEKKRSQASTPIFPKEGQMHEVVKKEIEKVLVRHHVSRSNHQQSYATTLYAKKAENKYVAREVFTSLTPKNLGNIWPDKFALYCEAAWRRYSDESANLEGELKKTKGNVPASFTNKLCFAHFQKWRADDCPEFYWPKEIKIPIRSVRLISVKDDTAVVPFSPGTHAYVKRTGFKEVQVFLAEDEKSFVPAFIPHWKSDKPICEKPIKADRKPIAVIRRGELVKLLKPTGPKNPPGAYRVSTTMQDNIQLIPAHIAKDKDALLASGFLANGVTISWKSFFAAVGYELPHPPSVKSQPPGAAEA

SEQ ID NO: 280 - protein, 1065 aa, Unknown
  Description of Unknown: uncultivated organism with predicted taxonomy: Verrucomicrobia
  MG1-285 effector
MITYELKKVALQNQTDEIVWAFDLGKGSIGEAVRRGNEFLHKASLLIPAEFAETRTARDRRRMFRTREAHKAREKWLCKVMHEAGIEILHGRNYDAAGNWKLGEPAEKRLEQEFPAPGDDTCYTSCLLRIKLLRGEKLEPWQVFKAFHSAIQRRGYDKDIPWKTRESRNPKAKDGDDDDAGTEKRMHDFELALEKMAPGKTAFHFPAYFDAHEMGLWSPDKPDGLKLRSDCHAKTTRNQIVPRKLVEAEIRQMVEGAAKHYPALADKADYLLYGIAQQSYASYKPELRQKFKLREGGATDWQGVVGQKIPRFENRIIAKCALIPRLNVCKLREGEKGQPHEKSLVAVEVAFLMKLKNLRVQRPGGNGWLSAEEIRGILEDPKRKDWKITESVWRKYCVRIGAGWLLGHEEVKSPRFSGRSRFCRPALEVLKRLILSGQKPSKFLQEEIVRLNGNKDPLKGLVEADLKFIGDMAAKNDAWEGIYIPNQQLDALVELSSDSAEAITTLIGRQNDPIVRHRLSVFYKGLRELEQTTKSRPDQVVLEFVREDFMGKKAKIEYFSFIKRRAEERIKAREEAANAGATEKSAGLKLELLRAQDGCCLYTNEGLVPSRLDEYQIDHIVPRSKGGPDAVVNYALTTQKANEAKADRTPYDWFHQEMPDKWDAYVNRVRSRATHLRNKKVQLLVALNAAELADKYTALAETAWIAKLAQAIVGLHFGWRNGVDESGNKRVTVISGGLTGRIRRKYALNQILNPNAKTEEEAEKKNRDDDRHHALDAMVISFIPSWVRDAMKEKFFRFPEPIHQNAKGFFEKEIQSVKPRNIALQKAAFEETIYGQRTIDGHKFIVGRESLASLAIKTTQNSQTIKKVSDIEFGRIVDARIQKDVKEFWESNPAATLESWKKWCADYRLGANGPLVNFVLVKKSKEDAVEEYKNVSKAGVSSERGQYKRGAKHRGYYIYERPAPTRKEPNKMQVEVCPVFVFQSKKAVQENLLKQTGIKMHGYFESGCQVRTQREWEFQGKKYPADEFILGSVWANRNAKFRHPIHQEIGPVGLRILLDAGFERI

SEQ ID NO: 281 - protein, 1294 aa, Unknown; identical to SEQ ID NO: 16
  Description of Unknown: uncultivated organism with predicted taxonomy: Verrucomicrobia
  MG1-287 effector

SEQ ID NO: 282 - protein, 1294 aa, Unknown; identical to SEQ ID NO: 16
  Description of Unknown: uncultivated organism
  MG1-288 effector

SEQ ID NO: 283 - protein, 808 aa, Unknown
  Description of Unknown: uncultivated organism with predicted taxonomy: Pedosphaera sp. Tous-C6FEB
  MG1-289 effector
VGNTQEHVWAFDLGKGSIGEAVRQGNDFKHKESLLIPHELARRGPAAVSGTPANKYRAKKTREAHLERERWLDTIWKVAGLTPLQARAVWENPETQKWELKHKGDYRLEREFAPKQFKKGAGGELVPIKYPNGKATDGAPAEKKADFETCYTSALLRIRLLQGDPSLKDWQIFKALRAALQSRGYGPVPWATKEARKQGRTPEELAREEEKKLQSADPRYREAVNKWQAFKDSVPKAFHFPCYFDAWKLGLWLHAKPDELGCRINHLAESTRNIRFDRADVRVELIRLGDQAAEILPALKKAFSDWQSGGWKYQHPVTGEKLTYPLRAKTFGEFLCDGPAGTPDESSFEAFLDQRHKAGLNRGSFEEWMAALGQKTPSFDNRILNNCVLIPRFHVCKMDVRLVMDEQGKLTGQIVTESLLATEVTLLLKLKNILVADPSAKDGQRKLTVGEVQDILAYAHRRLAELELVAADGTLLNLWPSKVAQRFSISKSSWRDVAVEAEFLRRMTASNIVVGSETRRLTIAEASSLLRAIANPKKGLEAQLPKDLQLLTKTAKSEFKKAKTASDEKTLRPMPGHEEVKAPKSSGRCGYSRVALRILKELILSGQAPSAFHSRLRELDTELLRKLGSSPEKPLVLIDDSKSQDQEQRKKENIENGKRGLLVSELNFLRQMRKERATEDSWENLFIPSQTIDALQQRHTQDGKLDSQSAIRELLGTINDPIVRHRLGVLAERLRKLQCGDEKRDSPGFGVPDAIVLEFVREDFMGEEAKREYQNFINEREKDRKAAREEAGKLGFDSRSSGLRYELW

SEQ ID NO: 284 - protein, 1048 aa, Unknown
  Description of Unknown: uncultivated organism with predicted taxonomy: Deltaproteobacteria bacterium RIFOXYA12_FULL_61_11
  MG1-290 effector
MTETSVLNERFHHGLVIGLDVGTAGLGWAVRRGPDLLDLGVLVVPEKVGNLEERRTLRRMRRTIRSRRQRMQQLRAMLTEVGLPSPGANAELDSPAVLRLQALNGEPLRPEELHAALFHLWKHRGWLDAWWKKKTVERTADDEPELTAEQKTAQKEAKETAARIAGLLAAMKDRGCRFACHYLALKEGRWDRTMGCLPRPKPGQAIAPEGHKNLIFPRELLREEFLAIVEAQRERWPTLYVARERILYGAWGEDSHHPAPEAAGRQHRLHGGVWHQRQARFDNRKPGKCVACGVNNVCRADAPEFAEAQRAIVLGNYRVFSAVQGKAVPVGQAALPELADILAKHQAGLKELRALAKTGGYTPLEPGIKKKDQARDLLVQQWADRNGYELLPGQQLTARKLSDGRCAFCRPCLRAVRYEYERTGTIRTFQPLLRRPGESLASARARYVRELRNPLVRQRVEALDRLLDRLERDHGSPAVIVVEAVRSLGLGKKANDDLKKKQATQREEREAARQEAAEHHAAGSQAVLRFRLAKEVGKVCPYCHQPFHADLADAEIEHILPRALGGSDQQVNLTVAHTHCNHEKHDQLPHAAWGEADRWPCLERFAREHFKGLKLQLFLHQGNPEEALALLAPPADLTQTAYIARALRGLCLLRQNWLTPEGRDPSDQPGGPGQFFQLTNGYLTAGIRRCWGLDELLPSALDDEGGKNRHDLRHHALDAAVIACTLPWAAHQPLSRGGWREAPPFGSARREQWRTPFDHLRSQIRARVPDIVPTQKVGTSAKQKMMNTTAYGPRPQRDRKGKETTVLVTRVPLVQLKEKQLNDIYPQVLMRYIAAALSEFRRTHGDEHAFQQKAPNTGKLSPAFVATLHNPGTGRPIHKVHVLGKDPAACREVRPNVFVEYTDATAYLVYPDPKKGRTWAVYLVKPWEKLGQLRASFPTPVYVFQKKQLIEFPREVVVSATNKAQAGKYRFMSCNKNGNVRLCPAHIVQGKEGFLSAGLPYYGFELHIRHLMEALGYGASPPPPAEAGVAAHPRPEPPHPQRRRGRRA

SEQ ID NO: 285 - protein, 932 aa, Unknown
  Description of Unknown: uncultivated organism with predicted taxonomy: Candidatus Termititenax aidoneus
  MG1-291 effector
ERLLREFPKDGDNTIYTSCLLRIALLQGKKLDGWQIYKAVWSAIQHRGYDKNLPWITRIKRNIEEENEDDSGAKNESTMDEKENIEGVGNYYKYLKDNFGDNKEFWYPCYYEAHKIGIWSPANLNDLSVKIGTNPNSARNKGKDKNYAVIPRELIKKELEELLKKAAEQFHKIKGKEKYIIYGLAEKEYASYIDKTFYKYRGKNWEWQGLLGQKVPRFDNRIISKCALIPRLNVCKAGDQLNKEVTFLMKLKNTKYVSHAGEELSFTSEQINKLFEKYKEKAYITKTQLEKWIKTELNGYSHPVHIKIDKSKTSGRSRFCRPALLIIKEIILSGKSPHDIYKEKITNNIITDSNKGLINGDYYFLLNMPKEWEKFWIPDKRENFSKISENKRIEEIETTIGEINNPIVRHRLNIFCDRLKKLKQKFSEPKKIVIEFIREDFMGDKKRREYIKIMNQRRKAKDEAFNEIKDLVKGKQSLIKQLLLKEQGCKDIYSYETLIPSQLNDYEIDHIVPRSKGGSDAMYNKVLTKASNNQEKGNRIPFEWLSADKEKWNMFYKNVESFRLNWKKKELLLAKDPTLLIEKYTTLAETAYITKLTQKIAHLFFGWDWQTKGSHRKIIVQSGGYTSKIRKIFKLNALLYPEKTGDEIREIVETGKNRDNKRHHALDALVLSITPEIKYDEKKDADVYPVWFNPEYCKNALDKVNPTYIDFEKPVLAETIYGKRTVNENGEKKEYFISKMKTGLEKEWYLDVINAKKYSKDIFDSRINKDFTREIEKNPTQEEWEKFVNIYFKNNRPKKLSLIQSDSPEIFKEINSIKGQYFTDKREHQGQLVYKNEKKWKVEPVFVYESLYLKRKEYEKKYGKVYFFNSLCQVKTNKDISFGRSNQLLSKGFYILRTITEGGQVKLESNNGLEFVIALSILMEEAQMERVD

SEQ ID NO: 286 - protein, 983 aa, Unknown
  Description of Unknown: uncultivated organism with predicted taxonomy: Candidatus Termititenax aidoneus
  MG1-292 effector
ERLLREFPKDGDNTIYTSCLLRIALLQGKKLDGWQIYKAVWSAIQHRGYDEKNHWKNDDDSAENKKNVNEYIKYCKDNKFEEKYWLPCYVDAHRMGIWSPEDSNNLYRKRNNETNPAPARNKNHSKYHLVFPRSKVEEELKHLLSQAAKLFPKLAGKENYIVYGPGEVQYASMKKMEFSKYRGKEWDWQGLLGQKIPRFDNRMLNKCCCMSHFNVCRADDMLNQEVMFLMMLKNMRYHSKNKPDEMLTAEQIKELFNKFKDRLKFEKNEKDKVKNRKKEVIPKSLLRKWVIEKLNGEIHPAHSLIPMPNAGGRSRYCRPALEVIREVILSGKTPKQVYEECVAKNKIENPEQNSKKGRIQSDFDFLIKKGTSEKWENFYISDNRYELREMSADERKIEIEKTLNEINNPIVSHRLKWFKKELNKLAFGEPEKKNPGYGIPEKVVLEFARDEFMGKQAKEDYYKFIKEQTKERKIVVEELEKAGFSKPSGEMIRKMMLFRQQDGIDFYSMQNIKLSHLGEYEIDHVIPRSRGGSDAFYNIILTTNKNNSAKGDKTPYEWLGKGDIWDNISEKLKVNKKMGSKKKLLFMASSEEQYKLLIDKYTQLSQTAYISKLAQKVTALTFGWGMQTKDDNRNIVIATGGQTARIRSRFKLDRLLHSGMTDEEFEKALRNGEIEKKNRSNPRHHALDALVLSAVPEIRVDKNRKGKYDDIYPSWLTRDFCEKEVAHVYPKQIKFSKAQLAEVLYGKREVKKEDGLWYTYAITRQNEGTRIEDYYVKKSEKKSDIEDMEKLRNKILKKVNHIFSNDIRTDFKKKLEEKPTEEQWNDFIKNYKVNGTCPHRISVIGNPGVKGFKEKQPLPPNYKEIRPNSKQYYETKTGQKWSYTAQLICLNEKDEWEVHPVYAWDSLYERIKKAEQEFKKVVKFHSRQSVEIKNDCANGKIKKGIYILATIQNGNWGVLESQGEKIDASLNELMNIGEMWPII

SEQ ID NO: 287 - protein, 983 aa, Unknown; identical to SEQ ID NO: 286
  Description of Unknown: uncultivated organism with predicted taxonomy: Elusimicrobia bacterium HGW-Elusimicrobia-1
  MG1-293 effector

SEQ ID NO: 288 - protein, 1033 aa, Unknown
  Description of Unknown: uncultivated organism with predicted taxonomy: Endomicrobium proavitum
  MG1-294 effector
MADEKLIYSFDLGSGSLGICVREGSNIKYLDSLLIDSEYASIKEVANRRRQIRTRLAHKARESWWIQQAQSAGIEVLSTKQPNKNNPNDKADVKMLKQFDKNDNQTIYSSLLLRIALLQGKKLEGWQIFKAVWSAMQRRGYEKVPWANDSDAEKNSKAVTEYEKKLENLFGDKKEYYYPCYYEAYIQGIWSPSEPSNFSKKLSNNPEPIRNKDKENMIVPNRELVYKELKDLLTQAAKQYPKLKGKEDFIIYGPSEEKNASYNNPKYKKYRGTNWDWQGLLGQKIPRFDNRIISKCKLIPRLNVCKANKKLNKEVTFLLMLKNMRFTKDGVTSCSLNHEQIRKLFETYKDNFSTKESRTNKALINSKKWKNYLEEIGAEANPNQKDIPQPKLCGRSKFCRPALNILHSLILSGKNPHDYYKELISVNNNTNPQKGLIKDDYKFLLNMPNDWNSISIQDTREEDKNLNEEERLYKIDRIISATQNRIARHRLLVLFEYLQKLKKQYGEPEKIVFEIAREDFAGEEKRKEYIDTQNKNTKNIELAVKLLKEANKQLNNRNILKARLLIEQNNVDLYEIDEHRKISITNIDDYEIDHIIPRSRGGSDSFSNFVITSINNNQTKLNRTPYEWFHQDKSFDAWNTYIKNIEGIKGLSKHKIKLLISDKAIELENKKTDLQATSQIEKEAQTIASLLFGWGINTKGDKKKILFFTGGNTADVRKNLNLNRLLHPALSDEEYNELKKKKDFKDKNRKNTKHHALDALVLSVLPEITMDKKSIENKPEFFNIKFCEEQLKKVYPIIIKQTKPKLRETIYSLKCRKENGKNLYYFVSRFEKNISMFKILSDAKKQVEKIFSLQIQKDFNDKLNDKNLTQEKWEKFLDEYTLNGRKIKKVSMIDSKSFKENDVFDINGNIKKIIGEYGQNKINGQWIKAKESHQGQIAFKENNKWKIVPIYVFESKYLKLKQYKEKYNDILFFKTGDLVELTKNYDEVKAGIYKLRTLKSSGTTKLTSLDTYEDIEKTISMFIEKCGMKLYKK

SEQ ID NO: 289 - protein, 1049 aa, Unknown
  Description of Unknown: uncultivated organism with predicted taxonomy: Verrucomicrobia bacterium 12-59-8
  MG1-295 effector
RLRMSEKSERLVFAFDVGTGSLGLAARRGNTMLEARSLLLDENYGKRDEQRKIIRAFRTRKAHLAREKYLQAVCEEVGIPVLKGRENSKKGDPRLEREFPRQGDSTVYNSALLRIMLLQGKKLEPWQVYKALHSAIQRRGFDKSVPWKNRPSNRKDSEEEDSKTAESASAYRQELIAAVGEDTQYQYPCYFAAYKMGLWDPKTHQLKQRINHHADTVRNYIIPRDLVVKELVDLLKAASRQFPRLEGREMRIIYGPSARAYASYYPDARAEYGLKEGGENDWQGLLGQKIPRFDNRLPAPCALIPRFNVARSNDIAIYEATFLMKLKNIRFYRDHLQNKDFNESSLTVEEIHQLLKEARQRAKEARQNGETEEHIAAAYSLNKTEWKKWLKKNCHAPISTHPCIEAPSSTGRSRYSRPAARLIRELVLSGQSPADFYKEAQDLCGKKGTPYYKLSKDDLVFLRYIKGEWQNIYIPVLPLSGDWSGKSTEMDLIREQIKKLIGAQRNVLVVHRIGLFYEQLERMISLYGVPDEIIMEFIREDFMGEEAKKKLQKFQNENRKAWDQARSQARELNLSGGGNVRKLRMLREQNFICPYTGDTLSENEVDTLEVEHIVPRARGGSDNQYNKVVTRTRTNREKGDHTPYEWLTQKEEFAAFCERVEKMGLSRKKKEILTAKDPFTLDQKWDSLAETAYIARVARDVAALRCGWQPGEAGEKRHIHIINGANTAKVRGLYHLNSLLASDQGGLEPDKFMKKVRENKKHHALDAMVLSFIREWIRNPKTRQYEFPAGIDREYFRKCLENVVPYNCILPKASLQETFYGTRLLEGSAGGKTVVVRTKITELGVTFNKFDQKKALKEAASIIDPFLKESIISALESRDFKLNEWQEWCQNFRHPRTEARVLKVQITAQKPDTKEYVNMAKEGEEDGFRGQYKLGAQHQGYFVYLEKDKKGNDIPKVRPVYAFHSHRKVEKELRAQGCDVIGFFQSQCLVEFKNDYEHGNIVIPAGKYILSTILSDGRFKLEGINDIPCPLKKIQDIRHSFRRVDGPDQ

SEQ ID NO: 290 - protein, 1089 aa, Unknown
  Description of Unknown: uncultivated organism
  MG1-296 effector
MNKIFSFDLGSGSIGECVREGKNILHLNSLLIDNDFASLAEVRKNRRAFRTRIAHKSREDWWRHCAKIGKLEILSTEQPSVKNPYAKPDKRMLTEFSKEGDNTIYTSCLLRIALLQGQKLESWQIYKAVWSALQHRGYDANVPWAKNIREIQKKKKEELTAKEKELLKDLEEENKASKLYSEKISVLPQEYQFPCYFEAYTLGLWNPNNPNNFIRNINCSTKNIRNKENREQIIIPRSFIQKELRQMLDNARKQYPNLPETDFILYGTPKKEYASYYKPAENKKYEREGILGQKIPRFDNRMISKCCCMPRFNVCKANDELSIEVRFLLALLNMRFTKGNTTTAQLSPEELKQIFEKYKGNLSNIKNDNVLVIKQAEWKKEIENKIGGKVNENQKAIPHPNTTGRTKYCRPALEVLKDLILSGKNPHDFYEEQIAKLNNTDPMKGIVKEDLSFLKLMPNKWEKIYIPDQREENKQLSFEEAQVKIEDIIKNITNAVVKHRLTMFYRRLTALTQQYGMPNKVVLELAREEFLGEDKRAQYIKTQNENRKDKDLAKEELMTVIKSADPSYQTKLLKVRLLREQHYKDVYDLTENCALSIQDIDDYDIDHIVPISCGGADSMVNKVLTKKELNETKKQNQTPYEMYFQNASAETWAKYLEHLKDVYGKNISKHLEKKYELLTSDKAIEIESKRNDLQATMYIEKYAQKITALFFGWGEQTKGDERHIFVCNGGLTAKLRKENGLDRLLWSEEEFYKLMASGKLDEKNRENKKHHALDALVISFADDLRTDPKTGRKLFPEFAQNNPAFFSEAMDKVFPKQLRKKAPPLRETIYALRCRKEKGVDKYYMVSRFNTELKTNFGDLKEASKQIDKIFDYQIKKDLQAKLADKPTKEEWLNFLENYKLLGKTPVYKVAMIASKAFSKEEVFDENGNKRHVIGEYKEMGKMKGQYLMPKEGNKGQIIFKQGKKWKVTPIYPFDSVTVKLKAAKQKYGKALFWSSGDTLILQNDIEGSEIYKEETKELVEYKNKKGKILTREKISSKEKTRPATLPKGKYKLNTLKTEGRIIITNLSSSKKYVTNLNIFIEGKVYKEK

SEQ ID NO: 291 - protein, 969 aa, Unknown
  Description of Unknown: uncultivated organism with predicted taxonomy: Verrucomicrobia bacterium 12-59-8
  MG1-297 effector
MSEKSERLVFAFDVGTGSLGLAARRGNTMLEARSLLLDENYGKRDEQRKIIRAFRTRKAHLAREKYLQAVCEEVGIPVLKGRENSKKGDPRLEREFPRQGDSTVYNSALLRIMLLQGKKLEPWQVYKALHSAIQRRGFDKSVPWKNRPSNRKDSEEEDSKTAESASAYRQELIAAVGEDTQYQYPCYFAAYKMGLWDPKTHQLKQRINHHADTVRNYIIPRDLVVKELVDLLKAASRQFPRLEGREMRIIYGPSARAYASYYPDARAEYGLKEGGENDWQGLLGQKIPRFDNRLPAPCALIPRFNVARSNDIAIYEATFLMKLKNIRFYRDHLQNKDFNESSLTVAEIHQLLKEARQRAKEARQNGETEEHIAAAYSLNKTEWKKWLKKNCHAPISTHPCIEAPSTTGRSRYSRPAARLIRELVLSGQSPADFYKEAQDLCGKKGTPYYKLSKDDLVFLRYIKGEWQNIYIPVLPLSGDWSGKSTEMDLIREQIKKLIGAQRNVLVVHRIGLFYEQLERMISLYGVPDEIIMEFIREDFMGEEAKEKPKKFQNENRKAWDQARSQARELNLSGGGNVRKLRMLREQNFICPYTGDTLSENEVDTLEVEHIVPRARGGSDNQYNKVVTRSQTNREKGDHTPYEWLTQKGEFAAFCERVEKMGLSRKKKEILTAKDPFTLDQKWDSLAETAYIARVARDVAALRCGWQPGEAGEKRHIHIINGANTAKVRGLYHLNSLLASDQGGLEPDKFMKKVRENKKHHALDAMVLSFIREWIRNPKTRQYEFPAGIDREYFRKCLENVVPYNCILPKALLAETFYGTRELNGKDGGKTVVIRTKIMELGVTFNKFDQMKALREASSIIDPFLRDAVSTALKSRDFKINEWQEWCRNFRHPRTGARVLKVQITAQKPDTKEYVNMAKEGEEDGFRGQYKLGDQHQGYFIYLEKDKKENDVPKVRPVYAFHSRRKVEEE

SEQ ID NO: 292 - protein, 1045 aa, Unknown
  Description of Unknown: uncultivated organism
  MG1-298 effector
MTKIFAFDLGSGSIGECVREEGKSPIHLNSLLIDSDFASLDLIRAQRRAFRTRLAHKARESWWIQIAQEAGLPIPAADIKKDKFGHYVFTADEKMLREFPKTNDETVYNSALLRIALIEGKKLEGWQIFKAVWSAFQHRGYETNNWKDEELSEEEKKAEQEEQKASELYKEKLSVLPKEYQLPCYYEAYKMGLLNPQTKQIVTRLKTSTGNARNKDGRGEQIIAPRNIVEKELRLLLKQAKKQYAALPDTEYILYGTNRKAHAGLKDHSARKFESEGLLGQKTPRFDNRIIAKCSLIPRLNVCKSKEPLSREVRFLLALKNFRFIKNGQVSAFDFEEINELFNMYKGRLLDKVHANYIDKRDIKNYLKSKQYEIFSEDVIPMPKDGGRSRFCRPALRILKELILSGKNPHDFYRESTENITNTDTTKGLVKEDYKFLLAMPNDWYKIHIPDFREEDKNLSQEERLAKIDNLLNSITNAVVRHRLIMLMHRIEYLHKIYGVPDYCIMEIGRDEFLSEEEKADLNRANKERQKNNKKAYEELKKYGLEISHDNMEKYKLCESQKWTDIYNVFDDKKKISPEDLPNYDIDHIVPVSSGGADSLANKVVTARHLNQSQKSNKTPYQWLFEDKIKWADFLENIKNAGIDKNSKKYLFLTAKDAVSQAKSLNDLQATRYIEKLAQKLISLYFGWGEQTTGDKRKMFVCTGGLTAKIRSQYGLNRLLHKDLSGEEFKKIVAEGKLDEKNRNNKRHHALDALVISFTRDIKYDNKGKPVLPDYACNPAFFADAIEKVFPVTIRSKKPALRETVYALRARQEGKELKYYMVSRFNTRIDELFKKISDAKDNVKKIFDLSVKKAFEDKLNTNPSQEEWEQFLKDFRVSGNPVYKISMINSKGFKKQDVLNPDGSFKNPIGEYRAMGKVKGQYLMPKEGNKGQIIYNNGRKWVVEQIYPFDSIVKKLKAAKEKYGKVLFWNTGITLCLPNTIKGSLITKDENKKQQSIPTDVKVSKYKLNTIKGTTVIITDLSSGLKYSASLTTLIEEGKAYKERS

SEQ ID NO: 293 - protein, 1097 aa, Unknown
  Description of Unknown: uncultivated organism
  MG1-299 effector
MNSTETVFAFDCGLASLGEAVRQGQSFPLVESWLIPDKFAETKSAAMRRRMMTTRDAHKERELWLLKTFEDLGIEVLRGKEVSKTPAGWSVTRKADPRLTREFPKPGDDTCYTSCLLRIKLLRGEKLAPWQIYKAIRSAIQKRGYDPDIPWKNREEKQQKKEEESAAVLFDETLLRKTVGDHPDWLYPCFLDAFRMGLWSPANPTQLGTRIDHKAQSTRKTIMLRALVEKELRDLLHQAAQQLPALAGKEEFVLYGPNGKYSSSSVRAGALAQKVPRFDNRIIDKCALIPRLNVCKVRMEGTHPHPASQIIFEITFLQKLKNMRVQGSSGIRGLAPAEIALAAFSQKNSLPSKAWAAFCEERGLYPAPAFKKLAFKDVAPVLPPEVFRSALLEKLASVSVLDSGKRVRNLTDDERSALLALMQKPRDSFSFTSSQWANFCEDLGASPLPGHEEIKPPKAAGRARFCRPAAHILKRLILSGQAPATFHAAEILNLGGSADPRKGLVAADLDFLLNMGDSWDAIRIPDGKLDAIACQYTDADEAIRKLIGSQNNPVVRHRLGVFAQRLRELERRFGVPDQVVLEFVREDFMGDKARMELKKFQNDRAKARAEARERVAELGISEKNSLRYELWKAQGGRCLYTDDPLAETELDNYHVDHIVPRAKGGPDSRLNYVLTLNQTNDDKDDRTPFEWLSCNPARWLAYVNRVESRLKAADGISRKTAQLLTLPNAVELAEKYTALAETAWISRLAQKIADLSFGWKNGIDAAGRKRTVVVSGGLTARIRRKYGLNRILNPGASSEEEAEKKNRSDKRHHALDAMTISFIPQWARDPGKTGFFRFPKAIRDNPLPFFQARIDAVVPRQLCYEKAPLAETIYGLRKTPEGNQVVKRTDLRDLAYQTVNMKTVFNIDSAVKNGIPKILDERIQSALLEFARLKPTEEEWNRFVADFTPFGSRVRRVRLVETALPPDTMGEFKNMSKDGTAMLRKPLKANKGQYVFTEPDGKIKVRPVYSFESPFQVRTLLLAEEPGRVIQGFYQTGCLVSLERDVEAGKHKIPKGVYRLSTIRADAFVGIFNTHGNLLGPVGIQHLLRSGFRRIDG

SEQ ID NO: 294 - protein, 1059 aa, Unknown
  Description of Unknown: uncultivated organism
  MG1-300 effector
MRPTESVFAFDCGLASLGEAVRQDLAFPHVESWLIPEDFAETKSAAGRRRMLVTRQAHKEREAWLRMTFQDLGIETLNGKEVAKTPQGWQEVKKADERLTREFPKPGDDTCYTSCLLRIKLLRGEKLAPWQIFKAIRSAIQKRGYDPDIPWKNRETEKKEEDKEKPAVTYDAETLQKIIGSNESWLYPCYFEAHQMGLWSPERPDHLEARITHMAGSTRKTVMFRSLVEKEVRALLQAAALQIPALKGKEESILYGPDGKYSSSSVREGVLSQKVPRFDNRIIDKCALIPRMNVCKIRMDGTKPHPASRVIFEVTFLQKLKNMRVQSAAGIRGLTHEEIELATVLQKNSAAPKAWAEFCDSRGLTPSPSCKKLVFKETTPTLPPDQFRAAILEKLKSVSVMDGQKMIRDLTGDETLAALELFQKPRESLGFTAAQWTSFCEDLGVSSIPGHEEVKPPKASGRARFCRPAAFILKRLILSGQSPKDLHVAEIKSLNGNTEPNKGLVPSDLDFLLKMGDSWVNIHIPDGKLDAISQQSGSPDEAIRKLIGSQNNPVVRHRLSVFAQRLLSLASRFGTPDHVVLEFVREDFMGEEAKKRYLKFMNDRAKSRAEAREKVAALGISDKNILRYELWKSQGCRCLYTDLPLEETKLDDYKVDHIVPRAQGGPDSRLNYALTHNATNDEKDDRTPYEWLSGDSVKWQAYLNRVNARLKAADGISRKTAQLLTLPNAAELAEKYTALAETAWISRLSQKIIDLTFGWSNGVDASGRKRSIIVSGGLTARIRRKYHLNHILNPDAETDEEAEKKNRKDKRHHALDAMTISFIPQWARDPDKTGFFRLPKEIRDNPLPFFAKRIDTVIPRQLCFEKSPLAETIYGTRSEDGVVQVVKRSDLRDLAYKTENMKTTFNMEFAKEKSIPRIVDERIRNALLHLVEKDLSEEEWNHAITQFAPFGSIVRRVKLIETTLSPGSMGEFKNMSKDGTPMLRKPKKANKGQFVYLEENGEIEVRPVYPFESTHQIKREILSGRKGRSIQGFYQTGCLVELTSEVRSGNTVIPPGVYR

SEQ ID NO: 295 - protein, 1098 aa, Unknown
  Description of Unknown: uncultivated organism
  MG1-301 effector
MKSKETVFAFDCGVASLGEAVRQGLDFPQVESWLIPDTFAETKTAAMRRRMMTTRDAHKEREMWLLNTFRDLGIEVLRGKEVSKTSAGWAVTRKADPRLTREFPKPGDDTCYTSCLLRIKLLRGEKLAPWQIYKAIRSATQKRGYDPDIPWKNREEKNQKKEEEETAAILFDEKLLRKTVGDNPDWLYPCYLDAFRMGLWNPARPNQLETRINHKAQSTRKTVMLRALVEKELRDLLRQAALQLPALAGREEFILYGPDGKYSSSSVRAGALSQKVPRFDNRIIDKCALIPRLNVCKIRMEGNHPHPASQIIFEITFLQKLKNMRVQGASDIRGLTPAEIALAAFSQKNALTPKVWASFCEDRGLHPAPAYKKLAFKDVSPVLPPETFRTALIEKLNAVSILDSNKRIRNLTEEEHAALLALFQKPRDSFSFSATQWSNFCEDLGVSPLPGHEEVKPPKAAGRARFCRPAAQILKRLILSGQAPAAFHAAEIHNLNGNVDPRKGLVASDLDFLLNMGDSWDAIRIPDGKLDAIANQCSSADEAIRKLIGSQNNPVVRHRLGVFSQRLRQLERRFGAPDHVVLEFVREDFMGEKARMELRNFQNRRAKARAEARERVAELGISEKNSLRYELFKAQGGRCLYTDDPLAETELDNYRVDHIVPRAKGGPDSRLNYALTLNQTNDDKGDRTPYEWLSGNPVRWQAYLNRVEARLKTTDGISRKTAQLLTLPNAVELAEKYTALAETAWISRLAQKIADLTFGWQNGVDAAGRKRTIIVSGGLTARIRRKYGLNRLLNPDASSEEEAEKKNRSDKRHHALDAMTISFIPQWARDPDKTGFFRFPKEIRDNSLPFFKARIDAVVPRQLCYEKAPLAETIYGLRKTPKENQIVKRTDLRDLAYQTVNMKTVYNIDYAVKTSIPKIMDDRIKSALLEFAQSKPPEEDWNRFVAQFAPFGSLVRRVRLVETALPPDSMGEFKNMSKDGTPMLRKPLKANKGQYVFVEPDGKIKVRPVYSFESPFQVQAHLLADNAGRTIQGFYQTGCLVELAKDTEAGKHKIPKGVYRLSTIRADAYVGIFNTSGNLLGPIGIQHLLPSGFKRIDG

SEQ ID NO: 296 - protein, 1098 aa, Unknown
  Description of Unknown: uncultivated organism
  MG1-302 effector
MKTPETVFAFDCGLASLGEAVRQGLEFPQLESWLIPDTFAETQTAALRRRMMTTRAAHKERELWLQKTFEDLGLEVLYGKEVSKTPAGWAVTREADPRLTREFPKPGDETWYTSCLLRIKLLRGEKLAPWQIYKAIRSAIQKRGYDPDIPWKNREEKQQQKEDKETAAVLFDEKLLRQTVGDNPEWLYPCYLDASRMGLWNPARPDQLETRQDHKAQSTRKTVMLRALVEKELRDLLRQAARQLPVLAGKEEFILYGPNGKYSSSAVRAGVLAQKVPRFDNRIIDKCALIPRLNVCKIRMADNRPHPASQIIFEITFLQKLKNMRVQGSGGIRGLTPAEIALATFSQKNALPPKAWTAFCEERGLHPDPAHKKLAFQDISPVLPPEAFRSALAAKLNGISIMDSGKRVRNLTEEERAALLALFQQPRDSYSFTSSKWADFCEDIGVASLPGHEEVKPPKAAGRARFCRPAAQILKRLILSGQAPAAFHAAEIRALNGNADPRQGLVASDLDFLLNMGDSWDAIRIPDGKLDAIASRCADADEAIRKLIGSQNNPVVRHRLGVFAQRLRELKRRFGEPDHVVLEFVREDFMGDKARKELQKFQNDRAKARAEARERVAELGISEKNSLRYELWKAQGGRCLYNDDPLAETDLDNYHVDHIVPRAKGGPDSRLNYALTLNQTNDDKGDRTPYEWLSGNPVRWQAYLNRVEARLKAADGISRKTAQLLTLPNAAELAEKYTALAETAWISRLAQKIADLAFGWHNGVDAAGRKRTVVVSGGLTARIRRKYGLNRILNPNVATEEEAEKKNRADKRHHALDAMTISFIPQWARDPDKTGFFRLPREIRDNPWPFFQARIDAVVPRQLCYEKAPLAETIYGLRKTPEGDQVVKRTDLRELAYQTVNMKTVYNIDYAVKTSIPKILDERIQSPLLEFARTKPTEEDWNRFVSGFAPFGSLVRRVRLAETALPPDSMGEFKNMSKDGTPMLRKRLKANKGQYVLVEPDGKILVRPVYSFESPFQVRAQLLAEKAGRTIQGFYQTGCLVELEKEVEAGKRILPKGIYRLSTVLADGRAWLFSHEGPLLPRLSLKPLLSAGFKRIDS

SEQ ID NO: 297 - protein, 1098 aa, Unknown
  Description of Unknown: uncultivated organism
  MG1-303 effector
MKTPETVFAFDCGLASLGEAVRQGLEFPQLESWLIPDTFAETQTAALRRRMMTTRAAHKERELWLQKPFEDLGLEVLYGKEVSKTPAGWAVTREADPRLTREFPKPGDETWYTSCLLRIKLLRGEKLAPWQIYKAIRSAIQKRGYDPDIPWKNREEKQQQKEDKETAAVLFDEKLLRQTVGDNPEWLYPCYLDASRMGLWNPARPDQLETRQDHKAQSTRKTVMLRALVEKELRDLLRQAARQLPVLAGKEEFILYGPNGKYSSSAVRAGVLAQKVPRFDNRIIDKCALIPRLNVCKIRMADNRPHPASQIIFEITFLQKLKNMRVQGSGGIRGLTPAEIALATFSQKNALPPKAWTAFCEERGLHPDPAHKKLAFQDISPVLPPEAFRSALAAKLNGISIMDSGKRVRNLTEEERAALLALFQQPRDSYSFTSSKWADFCEDIGVASLPGHEEVKPPKAAGRARFCRPAAQILKRLILSGQAPAAFHAAEIRALNGNADPRQGLVASDLDFLLNMGDSWDAIRIPDGKLDAIASRCADADEAIRKLIGSQNNPVVRHRLGVFAQRLRELKRRFGEPDHVVLEFVREDFMGDKARKELQKFQNDRAKARAEARERVAELGISEKNSLRYELWKAQGGRCLYNDDPLAETDLDNYHVDHIVPRAKGGPDSRLNYALTLNQTNDDKGDRTPYEWLSGNPVRWQAYLNRVEARLKAADGISRKTAQLLTLPNAAELAEKYTALAETAWISRLAQKIADLAFGWHNGVDAAGRKRTVVVSGGLTARIRRKYGLNRILNPNVATEEEAEKKNRADKRHHALDAMTISFIPQWARDPDKTGFFRLPREIRDNPWPFFQARIDAVVPRQLCYEKAPLAETIYGLRKTPEGDQVVKRTDLRELAYQTVNMKTVYNIDYAVKTSIPKILDERIQSPLLEFARTKPTEEDWNRFVSGFAPFGSLVRRVRLAETALPPDSMGEFKNMSKDGTPMLRKRLKANKGQYVLVEPDGKILVRPVYSFESPFQVRAQLLAEKAGRTIQGFYQTGCLVELEKEVEAGKRILPKGIYRLSTVLADGRAWLFSHEGPLLPRLSLKPLLSAGFKRIDS

SEQ ID NO: 298 - protein, 941 aa, Unknown
  Description of Unknown: uncultivated organism with predicted taxonomy: Verrucomicrobia
  MG1-304 effector
VRNDKDNSLEGQKRTQVYQDILKRNEDRRETARKALRASSLPDSDEMVVRWLLYQEQGPFCIYSGQPIRCSELPNLQIEHIVPRALGGPDAYWNWVLCKTDQNVEKGNRVPYQWFHEEKKSGEWEDYRRRVRNRATWLGSRKVDLLLRADAKELVGEKYTALAATSWIARITQSIVRLHFGWQLDDEPGKEKVMTISGGLTARIRRKYLLDSLLGTDKESQKVCEQVDQVLAEMEKLKSQPRSEETKVQWRELSQKRSQLARDSEKNRGDQRHHALDAMLLTFLPNWARDRNKEDFLRLEDIGDNAPYTDEGKRNAEKITDEIKKLVEETKPIYKQIKTARKANDFGEVDRLKHSIFPQRKRMAELFQSRDRLKQPRNIHKVRNWFREQLGGDRPVLPRPAAFKKVNIEATLYRCAYLIRNQTEPRRIPLPMLGRRPDFADDTQELFDLKWLRTRIQSITDADYDRAKLKALLGDRLKAAMSACLTHGHQFGEADWLAIVESKEVRELFSGKGRGKSKALPESADCQVKVFKVEMLPVKRYPLADLAYATGKTDVWNPVYFEDSISKILRRDESQPRGSRGKRRFQQIRPAPELPQGIASRWKGFFLDTDTQQKLKELQGEVAKIAALLPGPKPKKGETEKQNWEAADEKFGEALEEFRKKHDLPRKLFLFTSESDPPPKSPKTSLKRILFEPKDRIFSASVLKGQAADVVDLHFGRSLECFAESLLLVPDEQQRENLWKEFCNVVCIPTKKALQEFVAQKESISAKQWIDFFKSQDGPRVDQAEQEIGTLNEYCDLSKDGTGQFAKAGGMGGKPSYEGYFICKCKTDERIQAFPIRFFESKKTVRDRLNRSGWEMLDNSIWRSGELLHLKNKAVTKPKKQSQKPKEISSGYFMLGSIQKGTGVNLNACLGGEIPKAISLKILWDCGLRRASEPPHPSANV

SEQ ID NO: 299 - protein, 917 aa, Unknown
  Description of Unknown: uncultivated organism with predicted taxonomy: Verrucomicrobia bacterium IMCC26134
  MG1-305 effector
VFAFDCGVASLGEAVRRGLEFPQVESWLIPETFAETKTAAMRRRMMKTREAHTEREVWLLKTFEDLGIEVLCGKEVSKTPAGWTVTRKADSRLTREFPKPGDDTCYTSCLLRIKLLRGEKLAPWQIFKAIRSAIQKRGYDPDIPWKNREDAGQKKKDEESTAVLYDEHLLRKTVGDNPDWLYPCYLDAFRMGLWNPDRPEKLETRITHKAQSTRKTVMLRALVEKELRGLLRQAACQLPALAGKEEFILYGPDGKYSSSAVRAGALAQKVPRFDNRIIDKCALIPRLNVCKIRMEGNRPHPASQIIFETTFLQKLKNMRVQGSAGIRGLTAAEIALAAFTQRNSLPTKVWNAFCEERGLHPAPACKKLSFKDVSPALSPDVFRSALAEKLNGVAVMDSSKCVRNLTGEERASLLALFQKPRDSHSFTAAQWANFCEDLGVSPLPGHEEVKPPKASGRARFCRPAAQILKRLILSGQAPTTFHSAENRNIGVNADPRKGLVAADLDFLLNMGDSWDSLRIPDGKLDAIASQCSNADEAIRKLIGSQNNPVVRHRLGVFAQRLRELERRFGTPDQIVLEFVREDFMGDKARMELKKFQNDRAKARAEARERVAELGISEKNSLRYELWKAQGGRCLYMDDPLAETELDNYRIDHIVPRAKCGPDSRLNYALTLNQTNDDKGDRTPYEWLSGNPERWRAYLNRVEARLRAADGISRKTAQLLTLPNAVELAEKFTALAETAWISRLAQKIADLSFGWQNGVDAAGRKRTIVVSGGLTARIRRKYGLNRLLNPNATSEEEAEKKNRADKRHHALDAMTISFIPQWARDPDKTGFFRFPKEIRDNPHPFFQARIEAVVPRQLCYEKAPLAETIYGLRKTPEENQVVKRTDLRDLAYQTVDMKTVYKIDYAVKTGIPKIMDER

SEQ ID NO: 300 - protein, 1037 aa, Unknown
  Description of Unknown: uncultivated organism with predicted taxonomy: Verrucomicrobia
  MG1-306 effector
MTANETIWAFDLGKGSIGEAVRQGNKFLHKASLLIPADFAETKTAAGRRRMWRTRQAHKAREAWLDEVMRAAGIPVLQGRRVTWNEATKKWDVSLGDPRLEREFPAECDSTCYTSCLLRIKLLRGEKLEPWQIYKALHSAIQRRGYDPDIPWKNRAQRKAGTPDDDEAGTETRMKEFERRLEEMAPGKTEFQWPCYFDAKEMGLWHPAKPDELKLRQDCHAKTTRKQIVPRKLVEKEVRALVEAAAKFHPKLNGRADFILFGPAQRQYASFYADERKKHHLREGGANDWQGVLGQKIPRFDNRIIGKCVLIPRLNVCKIRTDDKGALLTQSRPAAEAVFLMKLKNMRLQCPGGQRGLTAKEIATIFTDPKRKKLGLTPTQWKNWCLLFGGKPLPGQYQEVKEPSFSGRSRFCRPALEILQRLILTGDTPQVAHDKERARLNGNTSPLKGLVPDDLMFLLKMGTTWEGIYIPNQKLDALAQSTDDPSETIRTLIGSQNDPIVRHRLTLFAERLNELAEKFGIPDAVVLEFVREDFMGKKAKIEYFKFQRDRAAQRAKAREEAAKAGAGEGAAGLKMELLEAQGGACLYTGEALAPTSLDDYVIDHIVPRAKGGPDSALNYVLTTRRANDDKADRTPHEWLSATNGWDAYVERVKKRTTALRNKKASLLVSPEAETLVQRYTALAETAWISKLAQTIIGLRFGWPNGIANGERKVIVISGGLTGRIRRKYKLNSLLNPDAKSEEEAEIKNRGDDRHHALDAMVISFLPTWARNSRFTGFFRFPDEVTRELFKREIAEVIPQNVCFERPALAETIYGARHDHGEKVIVQRAELISLAYKPTAPGKSVFDLKYAGKQTQSIRDNSIREGLAEFLSSGPTEIQWREFCGKYCLKNKDGTDGSRVRFVNMTVGDPTEYKDLSKDGTGAYRKALKGHKGQIVYLDEKGKPRVRPIYAFESAAAAKTELLSRNPKFRICGLFQSGCLVELTKPIEHPTNPLLPGTYKLNTILADGRAKVTDKTGKMTLPMSLEKFLAAGMKRIES

SEQ ID NO: 301 - protein, 760 aa, Unknown
  Description of Unknown: uncultivated organism with predicted taxonomy: Verrucomicrobia bacterium IMCC26134
  MG1-307 effector
HGHLRSEDLREWAKNYEGQFELRDPDFNLTPRNDFSGRARFSKNGMAAIRQIIANAREKHDAAYNTWEQRFKDKNLKANEEDIANGYARFLTQLTNEAASNQATADNSYARTVAPPPVLILPGETTDGAFQRYLNSIRNPQVRHRVELFGRELQRLMNLHSEDQAPDFIIIEMARDLMMNQKQKDAKEAKDRERRDERDKAAQILRDMGYAPTADNIKKFLLAQEVGWRCPFTLQAFCQSDFSRLTITQLAQAENKPRFLKEASSVFRRLEVEHLVPRTPVVCNEWYNLTVTLHSTNAQKGKRTPFQWLSIDKDGVPPDLDWDCACKNAADRFGANSLKYQIFTSPNAAEIIADNAKRSIQQTAYIARCLREACLIHFGKEWLDWTDGAGRDPLLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNAQAFDTTPYGRREKFGGDELGQPLFVARKRILDLKTSHLNPRNTGGFIFSPLIRDHIAKEWESFSGNEKNWIRIESDWIAIFEAQIATLRASGKDDQKTRLGIKARESRIYKLRQMEGCKDWEELLSFIAKELGAQQPQPKFPSQFIETLCHPIYKTPITSVKVTAQSKNDESFSLVRRPTSEKARSGTYVMRKQEDKYREMR

SEQ ID NO: 302 - protein, 1129 aa, Unknown
  Description of Unknown: uncultivated organism
  MG1-308 effector
MKMTQKQANNVFQRETVITKWQGAPFYTKDVVLGIDIGIEGIGIAVRRGPELLYCKTLMMKLPEQAPLEARRVLRSSRRARKSRRVRMNRLKQLFQKHGLPWVDDEIMARSDPFLLRDRAVNKNGLASKEALSICIRHLVAHRGYDFYAFLSDGEAPWGECSDFKAAKKWLSSTFVSEDIQEELLQDAENFFAEKDLEVWKALVQERLDWSRQNSMEKNLREYASNKANWRRGRGISYPRPQIEAHLRQIIERHKHLIKSHKKFTGVLFKKCDDDNKDICIFHYNRKTKEECEKVYERKIRTCPFAKYWDGAAQKCASRGDHAVRKWNLLDFLSNRRFRFAEGSIQIMRTMPEDCVKLLIDSLEESFDQKLTWSDHKQKLVESLKQHGLKIANPPKELSGKAKKSDAWKQLQDLLAPGKPLTSRAKLSSESAQKLFDTTTRNGTSFDPAQISARKKEMDYYEILSHTSMDYGVYPQVQKLLGTLRKPKAGEAPSFGTKGFLQRLFETELKDQLKRKTVPDRCIIECIKDPPRNKKEQDARASLNVENREFIENLLKDYGYEGAHSRSLINRLKLYRQQGGEAKDGQVTKEAVCPFTGMPLGKNPLSSDLDLAHLFPDGRGGLAIEDNLVLTKRSVNQDMGQRTPREVAGTRMGKTSFLSWNEMLARSKSFKWNDKKRELFAFEPAKGQPVPDFENLTRTAQLARQLRRMICFWMGIQEDSKETRERIGNPSGLHTAAARRGWKITKDRSDLTHHRMDAAVLSFIPPGAGLNSVMYGGIFEEVHSTKEINGNKFKVVQMRGAPELKPDLSALKKDSLTECPVINIRSKSKCKPLGDSTFWSVDEKGETWQRTTLIPLDKDALKDFTPEKIREKLAAEGIKESDIPGDRKLEAWLQNPKYSLHLKHGQPVRFVHKKGNKGDFRNPVGWSGIRHPNGKIDQLRKLDLVNDRLELWVGYDPKKGWQYYKRVIPSKDSMRGLKRLGIPWHGQEGLSEYTKKLINEENCKDLKEFYCGTLPQYSHKVGEFKLGDTFLIDVSKKKQKKQNAEGTEIFKDTPIPNSKEWFRVSAIILFREKGKKGIKRKVEFKPIITKGDSFTKEIACDLAQLLGKPKSPEKCAQQNGWKAPSNKKG

SEQ ID NO: 303 - protein, 892 aa, Unknown
  Description of Unknown: uncultivated organism
  MG1-309 effector
DELKLDSIRAWGKRGVLPEKYGNYLKLLIEDAGDFRGDKQAEALRIIDEAVARYRSDPIRTMLEEHLHERQHVNLRTPARGHNFPRELVKAHLREICERHRHFFPAEGFEEAMRELIGPVKNGAEEYDSKAESIMDWHRRTPGEARRLWERREGHCLLAPHLISTGLLPAGVYRRSPAGAGGIRRWKLVQFLAERRVELATGERTHVTADVVRQALDFVTADNAAVCERRRRPHAPKMPQAIEKAVGALASKKDSRLNADFFDQLGDLLKPSLSKLRGKAPLAEATAEALFQLATNGGANFEPEAIRARLNDSGYYDWRKHPGATRALYHQVDYLLGDARQYDPDTGEPKDHRDGAPRYHGLLRRLFAGQLRLDTGEIVDLRDRLDGRKVPDYVIIESVRDMPRNQDQSREIQKEQKERREERRHIAAIYGLDFDVLTEPQKRRLFLFHEQAGRDGEAVCPYTGESLGRDPLAADLEIEHIYPQRRGGLSIMENLAITRRATNAEKGNRTPVEWLGYEKAAEQASRMRWSKRKLEVFLWREERCPDWENLTRTAQLARELRRRVVEWLGIERRHAGIADPTQRALAREAEERRRVAAPAGALTAACREAWKDRLPEAYFTPIEIRGQTVLTKNRGNLRHHMWDAGVLAHIPPGDGLNHVRYGGIFETADIGGAPRPVPLPELAPDLAEIEKADPLACRVFHLRPRHPRSSRTTQQPVSLPDAEGRSWQRVAIRKTIHEKDGVVKTVEPENLLDAIRRAGLGPDRIADAEIERWKNDPRPIEQHPLRLRDGTPVHGLKIPIAQKKNEFGQYPHLTDAATAPDAPAYRSRDGRRQSRLIGIKGSTDTYDRLEIWRGPDLDRRGERRLDAKGQPKWKYFSFPVPGPRNLAAYRRM

SEQ ID NO: 304 - protein, 1205 aa, Unknown
  Description of Unknown: uncultivated organism
  MG1-310 effector
MNEYILREPDRKPLAEEWLNHEFYRSAVVLGIDIGLEGIGVYLRRGPQEIFARSIMLELPEAEALAERRQKRAWRHCRKNRKRRLHRLKLLFAKHGLPWLDADRISRAHPFRERYRAINNGVASKEALSICIRHCVVHRGYDYGGTEEGTFPWGESPLLSKAAEWLATAYVTPELKEQIEQLAPGLVPGKNEEEQRNKFAELLRERLEWSQQHDIARVLAEHVKGGHDNLRTRARGYNFPRQKVWEHLETIVRKHAHLIDDVEGFLAVLGLNPNRAANAKEAAKARKRAIFFYNRKTRFDMERHWEKKVNRCPFAGKLGGNPDERCAENGDLNVRRWKALEFATTRRVEIEATEGKGATKKKRRCLHSLSASATRKLIEFIEKHHGAASPATAPKWEEGKAIILDDITAVHGEKAKPVAEKQSEWNKSYFTQLKDLLTPTIANRKKRASLSAFAAGQLFNIATADGSDFTPENVVARLREARFYDWRRNASVDFNPFPQVELLLGRRIKHGKRRGELSPTCQGLLRRIFAEHREALGGATAPDYCVIEVIGDPPRNAQQRAERQKEIEANREKHEKLFEQYGIEDSGVASKRRRIMLYEQQRGKCPYTGKDLPSNPLDPSLEIEHIFPAEMGGLSVDDNLVLTWRSVNAEKGKRTPLQWAGERFDAMLANTRDMRWSARKREIFAWGTIREDKPDKPSHYNADGTLRVPDFGNTTRTAQLARQLRAEIMRWMQVDDKPDEAARRIGTPSGWLAAQARKSWLPAEEYEKVRNNVTHHLIDAAILAHIPPREGMNSVPCKGIFYVESVPVRDPVTGDTTYRLETKALPELSPLPRLKHWLPDNGEYDVCPVWKPRRQSKTQSLGDSTFWKQVRPTEATVAQRTALDADSLTKLRIVDGESLHAHLCRMGIQATKIPNRDALQKWLDEATAATKADKDKPIAPLKLTDGTPVKNLWKFDSKGSFSSPVGWSGKRNPDGKLRELRTISLKYDRLELWLGYDHQKAERARRAKQPDWEQAGWVYQKRLIPDARALRHVKQMGFSFARDKRHKAPAFMQNKPDKPETHQTLRDLVLGGRLLPFSHKVGEIRKGDVFKLHLLPDGSIRKRTPVGQPEPAAALSTFYVVTALKHGRGNPVVELTSQLFKDKEGTPMERFAGDVLSKILSTADDLAYVLGLPPAAEEAQKHGWRIPTSPPPPAAAAKETDGNLL

SEQ ID NO: 305 - protein, 1231 aa, Unknown
  Description of Unknown: uncultivated organism
  MG1-311 effector
MNELISPNTAWKTQSEYWLQHEFYRTAVVLGIDIGLEGIGLYLRKGPQEIFARSLILDLPQAEALAERRAKRAWRHCRKNRKRRLHRLQLLFAKYRLSWLPAERMSRSNPFKERLRAVTTGVASREALSICLRSCVAHRGFDYGGTEEGQYPWGGSSKLSDATQWLHTAVVTNELKDLIEDKLDELEADKSPEERRAAFRDLLRERLDWSLHHDIEMILREHAKGGHDNLRPRARGVNFPRKEVWKHIEKIVRHPRHREFLPDPEAFLKELGIDPNKAGGASPKERLANAARARRKAIFFYNRKAYPEMERHWAKKVNDCPYGQRLDPGLQGSKITCGEKGELPIRKWSALEFSATRRVEMETIFGKGKEKTIRRSLHSLSGGAVGKILKAIEQHDRALKSGDKSAAPSWDEVKAMLVEDLPPLANAKVKLATSKKGDWNETFLEQLRNLTLPSLANRKQRASLSALAAERLFALATQDGRDIDPAQFAPRLKAIGFYDWRRAATVDFNPYRQVEVLLGRRIKRGKKHGQLAESCQGWLRRIFADQSEALDGCTAPDYCVIEVIGDAPRTSRQAQEIKSAQDERGQKRRELFAAHNLEDSGIASKRRRISLWDQQKGVCPYTGKELPKDPLDPALELEHIFPAEMGGLSTDENLVLTWRTVNGDKGKHTPLQFASKLGVPFDQLVAHTKEMRWSGKKREIFAWGTLREAKDDQKSHYLPDGVTLRVPDFGKTTRTAQLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQSKTQSLGDATFWRQVRQGEPTLAQRTVLNPENITDADELKATLQRMRVDWNKQKQQTESKIPSRDALQDWLDAATPTTKADKNRPIPTLKLTDGTPIKSMWKIDSKGSLTSPVGWSGKRNADGKLRELRSISLKYDRLELWLGYDHREAERARKSKTLDWEQSGWVYQKRLIPDARALRHLKQMGFSFGRDKRRKAPAFMQGKPDKPETHLSVRDLVLGGRLLPFSCRVGAIKKGDEFLLHLLPDGSVRKRTPGGEAEPAAAFSTFYAVTALSHEGGNPRVELKSRLFKEKEGTPLERFPGDLTTRKVAVSSDLAFLLGLPPAWIAAQQRGLRPPSPQIEHAKTTTERNSRDPNPRLL

SEQ ID NO: 306 - protein, 923 aa, Unknown
  Description of Unknown: uncultivated organism
  MG1-312 effector
MERHWAKKVNDCPYGQRLDPGLQGSKITCGEKGELPIRKWSALEFSATRRVEMETIFGKGKEKTIRRSLHSLSGGAVGKILKAIEQHDRALKSGDKSAAPSWDEVKAMLVEDLPTLANAKVKLATSKKGDWNETFLEQLRNLTLPSLANRKQRASLSALAAERLFALATQDGRDIDPAQFAPRLKAIGFYDWRRAATVDFNPYRQVEVLLGRRIKRGKKHGQLAESCQGWLRRIFADQSEALDGCTAPDYCVIEVIGDAPRTSRQAQEIKSAQDERGQKRRELFAAHNLEDSGIASKRRRISLWDQQKGVCPYTGKELPKDPLDPALELEHIFPAEMGGLSTDENLVLTWRTVNGDKGKHTPLQFASKLGVPFDQLVAHTKEMRWSGKKREIFAWGTLREAKDDQKSHYLPDGVTLRVPDFGKTTRTAQLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQSKTQSLGDATFWRQVRQGEPTLAQRTVLNPENITDADELHATLQRMRVDWNKQKQQTESKIPSRDALQDWLDAATPTTKADKNRPIPTLKLTDGTPIKSLWKFDSKGSLSSPVGWSGKRNADGKLRELRSISLKYDRLELWLGYDHREAERARKSKTLDWEQSGWVYQKRLIPDARALRHLKQMGFSFGRDKRRKAPAFMQGKPDKPETHLSVRDLVLGGRLLPFSCRVGAIKKGDEFLLHLLPDGSVRKRTPGGEAEPAAAFSTFYAVTALSHEGGNPRVELKSRLFKEKEGTPLERFPGDLTTRKVAVSSDLAFLLGLPPAWIAAQQRGLRPPSPQIEHAKTTTERNSRDPNPRLL

SEQ ID NO: 307 - protein, 1129 aa, Unknown
  Description of Unknown: uncultivated organism
  MG1-314 effector
MKMTQKQANNVFQRETVITKWQGAPFYTKDVVLGIDIGIEGIGIAVRRGPELLYCKTLMMKLPEQAPLEARRVLRSSRRARKSRRVRMNRLKQLFQKHGLPWVDDEIMARSDPFLLRDRAVNKNGLASKEALSICIRHLVAHRGYDFYAFLSDGEAPWGECSDFKAAKKWLSSTFVSEDIQEELLQDAENFFAEKDLEVWKALVQERLDWSLQNSMEKNLREYASNKANWRRGRGISYPRPQIEAHLRQIIERHKHLIKSHKKFTDVLFKKCDDDNKDICIFHYNRKTKEECEKVYERKIRTCPFAKYWDGAAQKCASRGDHAVRKWNLLDFLSNRRFRFAEGSIQIMRTMPEDCVKLLIDSLEESFDQKLTWSDHKQKLVESLKQHGLKIANPPKELSGKAKKSDAWKQLQDLLAPGKPLTSRAKLSSESAQKLFDTTTRNGTSFDPAQISARKKEMDYYEILSHTSMDYGVYPQVQKLLGTLRKPKAGEAPSFGTKGFLQRLFETELKDQLKRKTVPDRCIIECIKDPPRNKKEQDARASLNVENREFIENLLKDYGYEGAHSRSLINRLKLYRQQGGEAKDGQVTKEAVCPFTGMPLGKNPLSSDLDLAHLFPDGRGGLAIEDNLVLTKRSVNQDMGQRTPREVAGTRMGKTSFLSWNEMLARSKSFKWNDKKRELFAFEPAKGQPVPDFENLTRTAQLARQLRRMICFWMGIQEDSKETRERIGNPSGLHTAAARRGWKITKDRSDLTHHRMDAAVLSFIPPGAGLNSVMYGGIFEEVHSTKEINGNKFKVVQMRGAPELKPDLSALKKDSLTECPVINIRSKSKCKPLGDSTFWSVDEKGETWQRTTLIPLDKDALKDFTPEKIREKLAAEGIKESDIPGDRKLEAWLQNPKYSLHLKHGQPVRFVHKKGNKGDFRNPVGWSGIRHPNGKIDQLRKLDLVNDRLELWVGYDPKKGWQYYKRVIPSKDSMRGLKRLGIPWHGQEGLSEYTKKLINEENCKDLKEFYCGTLPQYSHKVGEFKLGDTFLIDVSKKKQKKQNAEGTEIFKDTPIPNSKEWFRVSAIILFREKGKKGIKRKVEFKPIITKGDSFTKEIACDLAQLLGKPKSPEKCAQQNGWKAPSNKKG

SEQ ID NO: 308 - protein, 953 aa, Unknown
  Description of Unknown: uncultivated organism with predicted taxonomy: Verrucomicrobia bacterium
  MG1-315 effector
AGASKKERLPHAAPPRRKAIFFYNRKSRPEMERHWATKVNECPYAHRLDPGLAGTKITCGENGELPIRKWSALEFSATRRVEMETIFGKGKEKRIRRSLHSLSGRVVGKILETIERHDRALNSGDKAAAPSWDEVKAIIEDDLRTLADAKVKLATSKKGDWNETFLAQLRNLTLPSLANRKQRASLSALAAERLFALATHDASDIDPAQFAPRLKAIGFYDWRRAATVDFNPYRQVEVLLGRRIKRGKKRGQLAESCQGLLRRIFAEHSEALDSSAAPDYCVIEVIGDAPRTTKQAQEIKFAQDERGQKRRELFAARNLEDSGVASKRRRISLWDQQKGVCPYTGNELPKDPLDPSLELEHIFPAEMGGLSTDENLVLTSRTVNSDKGKHTPLQFANKLRVPFDQLVAHTQDMRWSAKKREIFAWGTLREDKDDQKSHYLPDGVSLRVPDFGNTTRTAQLARQLRAEVMRWMHVEDQPDEAARRIGTPSGWLVAQARKSWLAASDYQKVRNNLTHHLIDAAVLAHIPPREGMNSIICKGIFYDVRERVRDEATGITSHRFLTKALPELSPLPRLKQWLPDNGEYAVCPVLKPRHQSKTQSLGDATFWRQVRQGEPALAQRTALNPENITDADELHATLQRMRVDWNKQKQQTENKIPSRDALQNWLDTATPATKADKHKPIPPLKLTDGTPIKSLWKFDSKGSLSSPVGWSGKRNLDGKLRELRSISLKYDRLELWLGYDHKQAERAHKSNTPDWEQSGWVYQKRLIPDARALRHLKQMGFSFGRDKRRKAPAFMQDKPDKPETHLSLRDLVLGGRLLPFSCNVGAIKKGDEFLLHLLPDGSVRKRTPAGQAEPAAAFATFYAVTALSHEGGNLRVELKSRLFKEKEGTPLERFPGDLTTRKVTVSADLAFLLGLPPAAVAAQHHGLRPPPPRIEHPKATTEMIPRDANPRLL

SEQ ID NO: 309 - protein, 993 aa, Unknown
  Description of Unknown: uncultivated organism with predicted taxonomy: Thiorhodospira sibirica
  MG1-316 effector
GPGLDALEPFRKDRKTGAWIPQHTLRRDSLFFKEWQSEVALRNFRVKRRLITVGRSKKEKFELIPPPPVALERLRNLWNEHGHLWAEDLREWAKNYEGQFELRDPDFNLTPRNDFSGRARFSKNGMAAIRQIIANAREKHDAAYNTWEQRFKDKNLKANEEDIANGYARFLTQLTNEAASNQATADNSYARTVAPPPVLILPGETTDGAFQRYLNSIRNPQVRHRVELFGRELQRLMNLHSEDQAPDFIIIEMARDLMMNQKQKDAKEAKDRERRDERDKAAQILRDMGYAPTADNIKKFLLAQEVGWRCPFTLQAFCQSDFSRLTITQLAQAENKPRFLKEASSVFRRLEVEHLVPRTPVVCNEWYNLTVTLHSTNAQKGKRTPFQWLSIDKDGVPPDLDWDCACKNAADRFGANSLKYQIFTSPNAAEIIADNAKRSIQQTAYIARCLREACLIHFGKEWLDWTDGAGRDPRLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNAQAFDTTPYGRREKFGGDELGQPLFVARKRILDLKTSHLNPRNTGGFIFSPLIRDHIAKEWESFSGNEKNWIRIESDWIAIFEAQIATLRASGKDDQKTRLGIKARESRIYKLRQMEGCKDWEELLSFIAKELGAQQPQPKFPSQFIETLCHPIYKTPITSVKVTAQSKNDESFSLVRRPTSEKARSGTYVMRKQEDKYREMRVYRLPKPGRSGAYACWLLLPWYGMLDARGKRFKTVEKDLMTRACKGAKFVRAFRRDDIVCFANNLLANKGIKQNESWRIVRTDAKGDCLANVGLLPANLARETSHPITGEKVKLEPVVVALNDFMNALEPRLPTDELSHSPPVKPKSPGAAET

SEQ ID NO: 310 - protein, 1119 aa, Unknown
  Description of Unknown: uncultivated organism
  MG1-317 effector
AERMSRSLPFRERHRAVNKGVASKEALSICIRHCVEHRGYDYGGTEEGAFPWGDSPLLSKAAAWLSTAYVTPDLADKLQDIEPQLQAGRKEEEQREHFLYLLRDRLAWSGENDIARVLADHSQGGHDNLRTRARGHNFPRTKVWEHLEGIIRRHAHLRADVEGLLAVLGLDPNREPDAKRAVKAKRRAIFFYNRKTRLEMERHWAKKVNICPFAAKLGLDHPEERCAENGDVNIRRWKLLEFAATRRLEIDVAEGKGATKKRRSLLHRLSADAIRKLVETVQKHHAAVVASNRDAEPKWDESKDTILEDITTAWGERAKPIPETKSDWNKSYFSQLKDLLVPTLSNRKQRAALSAASAVRLFDLASADGMSFTPEEVIERLRKAGFYDWRRDASVDFNPYPQVEVLLGRRIKRGAKRGHLSETCQGLLRRIFAEHEEQLEGKTAPDYCVIEVIGDPPRNALQRAERDQEMKERREKRNKLFEQHHLDDSGVASRRRRVTLWEQQKGKCPFTGKELPANPLDPSLELEHIFPEDMGGLSVEENLALTWRTVNADKGKRTPLQFAAKLGVPFDQLMAHTQEMRWSAKKREIFAWGAIKEDRGDQASHYNPDGALRIPDFGNITRMAQLARQLRAEVMRWMKVEGDPDEAARRIGTPSGWLAAQARKSWLAQGDYEKVRNNLTHHLIDAAVLAHIPPREGMNSVLYKGIFYVVREPVRNEITGTTSQRLLTKALPQLSPLPRLNHWLPDNGEYAVCPVLKPRRQSKTQSLGDATFWRQVSPVEGTLAQRTVLNPEKITDADELHATLQRMRVDWNKKQQQTENKIPNRDALQAWLDAATPATRADKDKPVPPLKLTDGTPIKNLWKFDSKGSLSSPVGWSGKRNADGRLRELRSISLKYDRLELWLGYDHQKAERARKAKTPDWEQAGWVYQKRLIPDSRALRHLKQMGFSFGRDKRRKAPAFMQAKPDQPETHLTVRDLVLGGRLLPFSCKVGAIKKGDEFLLHLLPDGSIRKRTPAGQPEPSSAYSTFYAVTALSHEGGNPRVELKSRLFKEKQGTPLERFPGDLITRKVAVPSDLAFLLGLPPAGMAAQQRGLRLPPPQIEQITTTTEMNSRDPNPGLL

SEQ ID NO: 311 - protein, 1000 aa, Unknown
  Description of Unknown: uncultivated organism
  MG1-318 effector
HRLQLLFAKYRLSWLPAERMSRSNPFKERLRAVTTGVASREALSICLRSCVAHRGFDYGGTEEGQYPWGGSSKLSDATQWLHTAVVTNELKDLIEDKLDELEADKSPEERRAAFRDLLRERLDWSLHHDIEMILREHAKGGHDNLRPRARGVNFPRKEVWKHIEKIVRHPRHREFLPDPEAFLKELGIDPNKAGGASPKERLANAARARRKAIFFYNRKAYPEMERHWAKKVNDCPYGQRLDPGLQGSKITCGEKGELPIRKWSALEFSATRRVEMETIFGKGKEKTIRRSLHSLSGGAVGKILKAIEQHDRALKSGDKSAAPSWDEVKAMLVEDLPTLANAKVKLATSKKGDWNETFLEQLRNLTLPSLANRKQRASLSALAAERLFALATQDGRDIDPAQFAPRLKAIGFYDWRRAATVDFNPYRQVEVLLGRRIKRGKQRGQLAESCQGLLRRIFAEHHEALDGSAAPDYCVIEVIGDAPRTSRQAQEIKSAQDERGQKRRELFAAHNLEDSGIASKRRRISLWDQQKGVCPYTGKELPKDPLDPALELEHIFPAEMGGLSTDENLVLTWRTVNGDKGKHTPLQFASKLGVPFDQLVAHTKEMRWSGKKREIFAWGTLREAKDDQKSHYLPDGVTLRVPDFGKTTRTAQLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQSKTQSLGDATFWRQVRQGEPTLAQRTVLNPENITDADELHATLQRMRVDWNKQKQQTESKIPSRDALQDWLDAATPTTKADKNRPIPTLKLTDGTPIKSLWKFDSKGSLSSPVGWSGKRNADGKLRELRSISLKYDRLELWLGYDHREAERARKSKTLDWEQSGWVYQKRLIPDARALRHLKQMGFSFGRDKRRKAPAFMQGKPDKPETHLS

SEQ ID NO: 312 - protein, 1078 aa, Unknown
  Description of Unknown: uncultivated organism with predicted taxonomy: Verrucomicrobia bacterium IMCC26134
  AKC83434.1 effector
MVLAFDLGKGSIGEAVRLGNDFVHVASWLIPQDLAARGPSAKPGTPASRYRAWRTRVAHRERENALRRICADAGIEVLAAKRVARDAADKKKWIVVSKADERLTREFPKKGDSTCYNSALLRIQLLRGVKLEGWQVFKALHAAIQRRGYDNAVPWKHRAVRDTETEEDGITQQRADSYCLALEQMAPNKPECQLPSYLDAHRLGLWDASRPDEYILRIDHHVAPARNREHPDNTPIVAPRELVIKETRALLTAAAKFFPKLAGREDEILFGRGGKAYASYFDDVRRAHSLRLGGANDWDGILGQKVPRFDNRIIAKCALIPRLNVCKATTRKDKTGAIISESLLPSEVTFLFKLKNVRVQRPDKSITGLKPDEIRTLFNDPKREPEKLSYTKKQWSKEIARFGCEAAAGHEEIAAPSFGGRSRFCRPALEILKKLILSGESPATAHSRELAERVKGNTNPQQGLVVSDLDFLSPARIGETWDGIHVADQQHGALLRLAAEQGPEVAIRALIGKVNNPVVRHRLEAFWGRLRAIEADLKKRFGRGPDEIAIEFIRTDFMGPKAKLALAKFQSERAEAREDARAQVGKIGADGRASPLKYELWKAQGGICLFVGESLAPTDIESLEIEHIVPRSQGGSDAFINYVVTTKATNKLKDNRTPYAWFEANGFTGWDAYVKRVEACATALRNKKVRLLTAPDAIELVERYTALAETAYIARLAQTVAALHFGWPINSQPGERRITIVNGGLTARVRRNYRLNSLLNPCPTGKDQKEWEEDADVEKNRKDDRHHALDAMVISFIPAWTRDPKKEKFFRLPDGVTPETFQERLEEVLPRQLHYERSELEATAFGQRTLGGKLYGVARVDFCNLVVKVALNGNRSLNIKPDGSGEADTIVDQAIRRDVQAFIDQNRATITLAIWDAWVSSYHRGGSNGPLVKKVLVTITNPDSLEEYADLAKDQSGQLRRGKKHKGYWILRILSPTKKDPTKTTLQVRPIYAHANPHALKAEIGEDHGCEIILELESGCLVQIDKPIAHAKTPLAAGIYKLNSVWTQGNVVVSSQSGVTSAPIGLAKFIEAGLRRLK

SEQ ID NO: 313 - protein, 1078 aa, Unknown; identical to SEQ ID NO: 312
  Description of Unknown: uncultivated organism with predicted taxonomy: Verrucomicrobia bacterium IMCC26134
  AKC83434.1 effector

SEQ ID NO: 314 - protein, 862 aa, Unknown
  Description of Unknown: uncultivated organism with predicted taxonomy: Verrucomicrobia bacterium 61-8
  OJV06180.1 effector
MEAYVDELNAMSPLQLEFQLPSYFDAWKMGLWNPKNPTELKDRIDCHAQSTRNKIVPRWLVEKEIRLLAENAGKQIPELAGKSDYLLWGPTRRPYASYDCSVRKEFGLREGSVTDWQGVVGQKTPRFDNRIIEKCTLIPRLNVCKIKSDGKNPLPESRIVFETTFLMKLKNMRVQQGPTEQRGLSAAEINAIFKDEKFRSFKITEAQWNKLCISMGVRPQPGYETVDPPRSGGRSRFCRTSLEILKRLILSGKNPPEFLEEELRRLNGNTDPKRGLIADDLKFIEKMGSTWEEIHIPNQRLEAILQLAGGADAAVRQIIGSQTDPIVRHRLDIFYQRLQSLREAYGTPKSVVIEFVREDFMGKKAVIEYRAFLKKREAERKRAREDAAKTGSTERSAALKLELLREQGGICLYTGSALKETALEQYEIDHIVPRSKGGPDAVINYVLTLRSANDEKGDRTPFEWLSRTNQWDAYVQRVDSRGTVLRNKKTKLLLNENASELAERYTALAETAWIAKLSQAILDAFFGWKNGVDDEGRKRVISVNGGLTARIRRKYQLNSILNPSLNEEEAEKKNRSDKRHHALDAMVINFIPSWTRDTAKEHFFRFPSGIHRETFVQQIANVTPRNLCLEKPTLTETIYGARRGDQGLVIVQRAKIVDLAYRSITPSKSVYDLTYAAKQFKAIRDAHIRRLLEDFLKRNPTEQDWQEFCASFALPRRDGTLGSRVAQVTMNIGSASEYKDLSKDESGSWRRGKRHRGQIVYLTDGKPKVKPIYAFESEQEALKELLLSGAKIVGIFRSTCAVRLTEAVTHPKTPLVAGLYVLNTIREDAFAVLTDRSGARSQPISLNKLLAAGFQRVESLEI

SEQ ID NO: 315 - protein, 862 aa, Unknown; identical to SEQ ID NO: 314
  Description of Unknown: uncultivated organism with predicted taxonomy: Verrucomicrobia bacterium 61-8
  OJV06180.1 effector

SEQ ID NO: 316 - protein, 1324 aa, Unknown
  Description of Unknown: uncultivated organism with predicted taxonomy: Pedosphaera sp. Tous-C6FEB
  PAW75411.1 effector
MLRPCVRKDRLTVLCRPPGRLPSRREFLRLDQPRRAEGQLGIVTSDPCPCAGGKHLICRKAAGNNGSMSAKDYVLRGAVPMDSTLMPNHIWAFDLGKGSEGEAVRHGTDFPHVESLLIPAELARRGPAATSGTPANKYRALKTREAHRARERWLETVWTAAGFTPLHGRQVAKVCSLPVKLDENGEPKFDKGHWAQVAKGDYRLEMEFAPKLGTKTKDGAPSDLAGADICYTSCLLRIKLLTWKESGPKVADWQIYKALRSALQTRGYGRVPWAAKESQREQQTKEEEAKETETATRWAEFKQSVAPEFRFPCYYDAAKMGLWNPAAPNEPTPQNSHLANSTRNVRFDRADVECEIKQLAENADRILEGRLSLAKEKLVQEFMEGRRKRVREINERRALKNLTLPPDKRKQPRKDPAFQRISASVADFFCYGPSGVSCASYDRSLQADLALRAGSAYDWQGALGQKVPRFDNRILNDCVLIPRFHVCKVDVRVAEKDDDKQGVKAGQVFADSLLATEVTFLLKLKNVLVADLEKGQRKLKAHEVRAIFEYAHRQLQSLKLLSQDGGLVKNWPGKVADCFALTKSEWGNKKKGIGLLGLRPLAGHEEVKAPKTGGRSAYSRAALRILKELILSGEAPSVFHARLLKREPELLGRLGSSLAKPLALHADSTAQDAEQSKREDTEHRKCGLLVSELKFLLQMRKEDGQPDSWENLFAPSQTLDALKGRHTTDGKLDSEAAIRELLGTINDPIVRHRLGVFAGRLKKLQFGDAKENIQAFGVPDAIVLEFVREDFMGEKALAELQDFQRRREADRKEAKEMAAAAGATSSLSALKYQLWKAQGGECLYGKEVFNESGVSKAQCLYRGTALPFTKLDDYVIDHIVPRAKGGPDAMVNYVLTTHETNEAKGDRTPFEWLRSAPDWDAYNKRVAARAHTLRNKKVQLLTREDAPELVQRYTALAETAWVSKLAQAIVNLTFGWTNANDEEGRKRVIVVSGGLTARVRRKYSLDKLLYTNTTDPEVLTKQVKNRSDKRHHALDAMVLTYIPQWARDPGKEGFFRFPAEFRDATGREDYSAIQRLFKDKLAKTTPRFLAYERSGLADTAYGRRTDGEKCVVVQRTPLRGLAYKQVKMKSVFSLEYAATQVAAIRDGRIQAEMKRVIAAQPNEAQWRAICDALENGTHSGFEGVRVVKVTVNRNEDPAEFKDLSKDGTGALRMRKKEHQGQFVFLDSKGRPRVEVVRVFDSLRDVKARLAKEHAGLKEVGFFQSMCQVELDQPVKHGNCTLLPGTYLLNTIKQDGRAQLTSAGGDKSPEIGLVKLLPAGFRRKA

SEQ ID NO: 317 - protein, 1324 aa, Unknown; identical to SEQ ID NO: 316
  Description of Unknown: uncultivated organism with predicted taxonomy: Pedosphaera sp. Tous-C6FEB
  PAW75411.1 effector

SEQ ID NO: 318 - protein, 1086 aa, Unknown
  Description of Unknown: uncultivated organism with predicted taxonomy: Verrucomicrobia bacterium IMCC26134
  WP_082083265.1 effector
MSQVTGLPLVLAFDLGKGSIGEAVRLGNDFVHVASWLIPQDLAARGPSAKPGTPASRYRAWRTRVAHRERENALRRICADAGIEVLAAKRVARDAADKKKWIVVSKADERLTREFPKKGDSTCYNSALLRIQLLRGVKLEGWQVFKALHAAIQRRGYDNAVPWKHRAVRDTETEEDGITQQRADSYCLALEQMAPNKPECQLPSYLDAHRLGLWDASRPDEYILRIDHHVAPARNREHPDNTPIVAPRELVIKETRALLTAAAKFFPKLAGREDEILFGRGGKAYASYFDDVRRAHSLRLGGANDWDGILGQKVPRFDNRIIAKCALIPRLNVCKATTRKDKTGAIISESLLPSEVTFLFKLKNVRVQRPDKSITGLKPDEIRTLFNDPKREPEKLSYTKKQWSKEIARFGCEAAAGHEEIAAPSFGGRSRFCRPALEILKKLILSGESPATAHSRELAERVKGNTNPQQGLVVSDLDFLSPARIGETWDGIHVADQQHGALLRLAAEQGPEVAIRALIGKVNNPVVRHRLEAFWGRLRAIEADLKKRFGRGPDEIAIEFIRTDFMGPKAKLALAKFQSERAEAREDARAQVGKIGADGRASPLKYELWKAQGGICLFVGESLAPTDIESLEIEHIVPRSQGGSDAFINYVVTTKATNKLKDNRTPYAWFEANGFTGWDAYVKRVEACATALRNKKVRLLTAPDAIELVERYTALAETAYIARLAQTVAALHFGWPINSQPGERRITIVNGGLTARVRRNYRLNSLLNPCPTGKDQKEWEEDADVEKNRKDDRHHALDAMVISFIPAWTRDPKKEKFFRLPDGVTPETFQERLEEVLPRQLHYERSELEATAFGQRTLGGKLYGVARVDFCNLVVKVALNGNRSLNIKPDGSGEADTIVDQAIRRDVQAFIDQNRATITLAIWDAWVSSYHRGGSNGPLVKKVLVTITNPDSLEEYADLAKDQSGQLRRGKKHKGYWILRILSPTKKDPTKTTLQVRPIYAHANPHALKAEIGEDHGCEIILELESGCLVQIDKPIAHAKTPLAAGIYKLNSVWTQGNVVVSSQSGVTSAPIGLAKFIEAGLRRLK

SEQ ID NO: 319 - protein, 1086 aa, Unknown; identical to SEQ ID NO: 318
  Description of Unknown: uncultivated organism with predicted taxonomy: Verrucomicrobia bacterium IMCC26134
  WP_082083265.1 effector

SEQ ID NO: 320 - protein, 1333 aa, Unknown
  Description of Unknown: uncultivated organism
  MG2-1 effector
MPTTNPYVITHVTKNWMKDEFYDSALVLGLDIGIEGIGVWLRKGREPLFARTFMVSLPEAAPLKNRRAKRAQRHARQSLRRREAMLREWVVRYGLLPQEKTDGRWWKNPAVFERAFEHRHRAITTGVASPECLVVCIRHLLRHRGFDYHLTDEGAFPWGDELDDKEIIQWAKNSCCAPEYRTHLCNLIEADAAWAKNSDGSFTEKYLKVRQALDDAVREYENRPVERMLEQHMSEKNHPHLRPRARGRNFARELVKQHLYAICEKHRHFFAPGTFDQAMRELLGDQTGPSQWKLTWMDQDGKARQTILDYHRRTREEAEELWKRKVKKCPFAPLLFEKRHPTTPQHDCAVRSDPRIRRFNLLMFLAERRIELETHDAEGRLQNPRVNLDANVVRDLLGDLEQDIRAVEALRNKQSASRPDKPGKKTFEQRWRICNDCGKETGQDETGKSSCCKAKTKPKMPLAGVAKGSFNADFFDQLGDLLRPELRSLKGRASLSGEAAEVLFKLVTRNGTDFEPARIRQALEDCGYYDWRTNLPAGLGIYPQVTFLLGNRGHYDKDGNPRQIDKTTGNPVHHGILRRLFAGQLRLDDGTLVGLKDKLDDKVVPDYVVIETIGEIPKNQKEKKEFQDEIKANRSRKTDIIEKKYGLKLDSLSDWQVKQVLLFDQQANEEGEAFSPYSGVSLGTNPLAHDLEVEHIYPERRGGISVMDNLVITWRTENQTKGDRTPWEWAKDEGWRVDVHLQKMHWSANKRALFVRQESDPPQWDNTTRMAQLARHLRAEVIHWLGLDQIQDQKERNKEIARRIGTPTGFQTSVCRESWTPPHVFPQMYRLLCDKKGVPVRDRNGQERWVKDRTNLRHHLWDAAVLSHIPPGVGLNSADCGGIFVHRRDPQNGEWSVSALADLGPDLVAFEKANADRCLVVRLRQRKSKKSRYKETIFSLPDQQNRVFAREPLSKVVTSLLKSKKKNPDAELRKLLDRPGLLNPLEITNKKTGQTKQIKLLNKADVERWLSCKDVSLDQEGFRKFIEDVGVPTEQIPDDAVKAAFMKRNGETLLRKTFKPNSLVSFIRQKCRIKDSEIEARVEIAIAERNERTVLRAANGRDGQPGQVIRSILIEQDKLPPCGFGLHFNPTAKPKRGSEVAGFKPVDNSNSVVYLRREIWIGQRTKKKGRKTTVETFYKSRLIPHPRHLASYQKLHGQPWKADPLPLGMKLAGKLAVGDLLRIPLKKEKRNRNDNLIAKRGETPLESRFYRVKSMKTNGTIEFQMAEFAEPKLVKGQIPDPATERLLETYELTCSNEADLLWLLEVTTGKRIKLPPPVVENAPTTGKREGELL

SEQ ID NO: 321 - protein, 1080 aa, Unknown
  Description of Unknown: uncultivated organism
  MG2-7 effector
MKQGQIAFSFDIGHSSIGWAAFQVSDAPGTFHSLLGTGVVLFPKDACLASARRGFRRSRRNIAARRSRIDRLKNYLAGLGVLSRDQLDANSNSYPWLLAARILASDGKKTLTWEELWSVLRWYAHNRGYDGNALWAGDDADAGDKEDTDKVKNSIALMEKHKTATMAETVCKALGLDPMGEVKASRIYFKGNNAAFPRGVVTEEVRRILAAHAGKLPKVDDALSDILLRNAATSGLELPARFKGGLLFGQYVPRFDNRIIPACRITGKNTPLKRCPEYLLYRWGRLLNNLTVFGADGQIRTLLPAERQALHSRMEADGFFTKRTLNAALKDVTGCTPANTESFFLTEEMEEALVLDPVKKLLATNQIMKDLWPQLSAESREKAQSSLSAGKKIRLGDILAEMETAGQDTTAASDALASHQKKAKKKNADLATRRLSADYPKGRAAYCREILAKTFDESISGKDSTKEGGCLYETEEIRNRLLREPLVQQTNNHLVRHRLLVFERLLAHMVEEFAGGDEKRIAATVVEVVRELQEFSGLNSKEITHKLNEKLGNFRSVVKNLEEAIANSEERVAITGSLIRKARILEDQGFVCPYTGTHLSYNHLLADRLEIEHIIPRSLRPSDALSSCVMTFRSVNDMKGQRTAMQFICEEQGREVPGHENIQITTKKAYVDYVAKHKKQYPQKSDDRRRCERRAELMLMERYDQRNADFTERDLTQTSHLNKMAIRLVKQRIGIDAKHLPGNVTAFIRQKLHIDECLFNAVPRLQTAAKGQPKSSKRKKKAEEAPVEPIQDDMPPRKLTKADIRELTYLHHAMDAVTQGLALLLFAPEDWPLLVKRNLPDSEQRHLKARYPFLDFSADKHISIQDLPEDTLHTISERLAECRVVRHIPAKMHGIIVDQTTWGTVAAGAITTLRQKTTEKNARCDENGKRFIKTTEKKRSLLLGGPDAPDGKLAKIKGAILVTENWGCALDPSPTVIPHFKVYPQLRALREKNGGRPIRILRKGSLIQVKAGTYQGIWSVASIKDNADGICLDINAADKVKLENRSDDSKINVRLDSLRKSGLKILKPKLTGACPTTSSP

SEQ ID NO: 322 - protein, 1471 aa, Unknown
  Description of Unknown: uncultivated organism
  MG2-3 effector
MGNRADLELAFDVGHSSIGWAVLKTQPELEMKGCGTVIFRPDDCLASKRRDYRRQRRHIRSTRLRIERMTNLLLGIGAITQSDVESGKKQHKGEPPPWLLAARVLAARTETEKAKALLTWPELWKVLRWYAHNRGYDANVRWSGESKVEAFSPSPQINTEDVEEQAVEAEESELADVEVAEDSDSDSDKLRAGKHLMSSKYGFHTATFAETVAKILLGPKRDVKPGQAGKTGKLAETTESFSESDFRKLLFDTPTESWSHPRHLSIYFKGIRAAFPRRIVKVIGGQRTLVGGTEWEVRAILRAHFDAPKGKALCDETFEAAICGRLPETREDWRAYAETHPTLYLSSDDQAKLRSLRAPPKASQEKSERIRQQRRNILTGKLFLPSRYEGGLLFGQLGTRFFNRIISRCPFSFARIVAAILSGDENTLRLYGTTLAAVNRSRHSRNGVMETDLDLARRWAAKLSKVPAAKSREFLLYRWAMTLANVIVARPGRERLTGYERRCIHRRLRRTGYFTKDSFKEAVRQTTGCEPANLDQMFDTTTEAENSLFIDPVRKYLATNEVAGVVLPVLSQFLQVRLARLLQKGKGVRVREIAEWLDETAKRELSQRIEQYVQENNAKAKAAKKKPHDTHSPDEDRRKKQNKLTAAAVLRVRLEAPLPKGRASYHRVVLRKAVAEVLKGFDPRKPKRDRSNTDGENKPSHGCLFRTPETNRQLLGNPNNEAEYERWKQRWLSHQKNYQRYIARERLSPGSGEAFVRSEYHAAQSYRWLASQSNNHIVRHRLTILDRLLRDIIADQNYCAGDPKRIRRISIEVANDILTFSGLERKQLSGQVMPSLREHHDHVVRLLQQELKGTQWENKIDGELIWKAKIADDLGWWCPYTGKKYSPCELASGEMDVDHIIPKSRRLTNAMSAVVVTFKTINNLKGDLTAWEFVERYQDQPVGPHGEKVRKLWDYERFVKNPDNEMDKPRLSGETGHSDYPRWPKYLPGSRRKLHPDYVRRKLRRRYLLLKHYEKDKDTFTPRDLTITSHLNRLAQQVLLRSLPHLAEHQITAIPGSVIGVLRDAPGWRLLGCLDGAATADVIRKVLQLDHEGKPMCASDVAPLMKRIPKPKGEIRELTHLHHAVDACAIAIINHLLPKDGKLWELVAKRELTDADKNAYDDLRQKNQSQWQPRRLARLFSIVPNLDDKGQQPKHDHKWRIRPCRLKDVLPDIGAQVNKCLRERRVVEHTPADMSGLAAEETVWRIFDPSDNHPSARRLKQWFEKKIKDGEIQKLPDPTNEADKTVLIVCRKRRDAKSNDKGKTLHDTGNVWRWVYDEVNKVRVVGLNPGKLHRIKAVKLIRENFGIALDPEPTIVPFHKVWQRLMELKAKNGGKMPRVLRNGQLIRVLSGSRAGLWRVTSVKQTEAYGLVLDLAYPDSVHLSRPNAPVEQLLKEGLEILKHSLTGYDASVVAYAPVKRRPRKPKAAQSEQ

SEQ ID NO: 323 - protein, 1196 aa, Unknown
  Description of Unknown: uncultivated organism with predicted taxonomy: Verrucomicrobia
  MG2-5 effector
MNNKMKIPTMKIAASKADLQLAFDVGHSSLGWAVLQTTPEKASSIELLGCGVVTFRADDCLASARRGYRRQRRHIRSTRQRIKRMKTLLIHLGVLTKAQLDQPGCAWPWLLAARVLHGGKLLSWPELWDVLRWYAHNRGYDGNRRWTKQEVTPDESTDFDDSELERILSDATATEDEKSDAEKVKEAKILMRSHGVKTMAETFCAICGLDPLGQKKSCNLPGDKRPKAMNAAFPRAVVEGEVRRIMRAHFGGKLPKVDEALERMLLGLNSQDKVAWRAIPCPGLKLPKRYQGALLFGQLVPRFDNRIIATCPITHYQEYQRALGAIRDNDPAYLKKHSVNLDNHDPSWWAKHIADKLAKVPSRDCVEFMNFRWGMQLANIRVARFGEKELSPLKVEERKQLDDMMRAAGAMGPGEFKKSVRHVTSAIRDNLDTMLMHPDAKDALVLDAVQKLIRSDDLESIWKLLPERLQKRTRGRWRQGWRISFADLRRQLAELGGDTEAFDAELTRQVDAANVNLKKKGKQTTREELLKKPFFVKKLGQRAAFARHLLKQAYEEVMAGSHPKEKDGCLFISEEMREAQLQREIAQQTNNHLVRHRLLILTGNEKAKPHPKEGLLQHIIKEYAGGDGTRIGKITIEVNRDLREMSGKSNYDKQADLNNRVKNHHSVVEYLHEHLPAKYHNRINGSLIRKARVAADLDWKCPYTNEAIQPIHLITKVVDLDHVVPHALRPSDGLDSLVVTFCAVNKMKGKRTAWQFIKDEETRSVSYRNEQGKEEKVDGMPNLKIRFFSDYKKFVDDLKIKAKGEHKADAERRERRQQLLRLANYEEKAFLPRDLTQTSQLVRLAAQALRRNLPHLGPENVVSLPGSVTGMVRKSWNVTGCLELACPQVMEEVVDQDGKAVRRAKDKGEIRGITHLHHALDACVIGFSSHFIPNNGGLWELMVKRRWTPAEEKELEARRVFSKGMDGRFQMTDLHKRHKEAIRQRLAEKRVVQHIPARMDGLRVEQNMWRVVSVKDGEATLRQRIRHVDGSRPKKAGTEKKTKLLGLEPGKLQTNKGVLIIPDNFGVALVQPEPVIVPFHKVWVRLRDLKKVNSGTKPEIIRNGQIIRIAEGKYKGVWRVFSAKNNSTGMALDIGLPDVVRLKNKTEGHKINVLLSSLVKNGIEAIKAPLTGVPVSAGKGESHSSPLEPRQSSNAS

SEQ ID NO: 324 - protein, 1119 aa, Unknown
  Description of Unknown: uncultivated organism with predicted taxonomy: Verrucomicrobia bacterium
  MG2-6 effector
MQVENFLNKVENRELEVAFDVGHSSIGWAVLSRKTSQESQNVAEYFYPEIIGCGVVIFEPDTCLAKKRRDYRRQRRHIRSTRQRIKRMKSLLQHLGVLTEAELDKPGNSSPWKLAAKVLQNSGLLTWQELWDVLRWYAHNRGYDENRLWSETLPDDEKEESKRVENARKLMAQFQCGSMAETVCKMLGVDPLSTDKRSSHLRYKGTDIAFPRNVVVREVREILKKHIGKLPQVSEQLVETLTGDKENSWKTIPCPSINLPKRYYGSLLFGQLLPRFNNRNIARCPISGEKLPLKECVEFYRYRWAMLLCNIRVKVNGSKERPLNVNEREYINGIMEKKGFFTKHELRIAVNDAVMQTLKNENYNGTPVILTNISAMFLTEDMEKALTLYPVKKIINSEKVQVFWNIIPERLQKRISGLWRKGKQITPQEFRNQLEKISPEKLLDFDNAVEEFLKKNRKEKNYLESKIPDSPLKDLQGRAPFSKAILKKAYEEVLSGRDPREEGGCLFRSEEIRLRELNKKITEQTNNHLIRHRLLILERLFDDIVKEYANNDKNRIGQVTIEVNRDLREFSGMTAKEIASELTKITSDHRKAVQYLEENLKGKPYKITASLIRKTRIAMDLDWTCPYTGQKYDIYDLLEKRVDLDHIIPQSIRPSNSLESLVITFPEVNRFKAQRLAFQFVKEEQTKTVKGLPNLQIRTLENYKNWGENLKESRFDRNKSPQSKRKKLLLLPEYVQEEFLPRDLTQTSQLVRLAAQVIRKKYVDSKEPKIVSMPGSVTAVFRKSWKVMGCLSKAVPAILDENGEVRPKDEIRNITHLHHAIDACVLALASHLFPNNGRLWELLVKNKLNSSEVDELKKIPLVQVGVDNKINISDLPEFIKEQISNRLLERRVVQHISKDMSGLKCDETVWRVVDQNCDNSYGKKLLRWCKEMNVEIPAPDSDSVLIVSRKRKDKGTTKPTKILHESQSFWWQYDIVKKSKVIGLNPENGDGKLKKLKAVKIIGDNWGLALDPKPQIIRAFKIYQQVREIKNANDGKPPRIIRKGQLIYVPNGRYKGLWKVFSVKDKKTGIYLDIGEVDQVSLRSERKSAKENVDVRTLMKNGLRPLSTPYTGINACLIT

SEQ ID NO: 325 - protein, 1056 aa, Unknown
  Description of Unknown: uncultivated organism with predicted taxonomy: Verrucomicrobia
  MG2-8 effector
MASRRNAPDLQLAFDVGHSSIGWAVLQANPDVEIAGCGVVIFRADDCLASARRGYRRQRRHIRSTRQRIKRMKALLLHLGVLTQTQLDKSGCAWPWKLAARVLVGGKTLTWPELWDVLRWYAHNRGYDANRRWSAAEAEAEKEDTEKLENAKTLMDKHGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRLSGALVVGENFGVALDPQPTIIPFHKVWPRLQELKKANGGKLPRVLRNGQIIYIPKGTYSGVWKVFSAKNNKSGMALDMGRPDVVRLRNKTDGHKINVLLSSLLKDGMTIVDAPLTGVSSAPKQS

SEQ ID NO: 326 - protein, 985 aa, Unknown
  Description of Unknown: uncultivated organism with predicted taxonomy: Verrucomicrobia
  MG2-10 effector
MKALLLHLGVLTQTQLDKSGCAWPWKLAARVLVGGKTLTWPELWDVLRWYAHNRGYDANRRWSAAEAEAEKEDTEKLENAKTLMDKHGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRLSGALVVGENFGVALDPQPTIIPFHKVWPRLQELKKANGGKLPRVLRNGQIIYIPKGTYSGVWKVFSAKNNKSGMALDMGRPDVVRLRNKTDGHKINVLLSSLLKDGMTIVDAPLTGVSSAPKQS

SEQ ID NO: 327 - protein, 952 aa, Unknown
  Description of Unknown: uncultivated organism
  MG2-11 effector
WTAADIETLKEDTEKEENAINLMQKNGLTTMAETFCKELGIDPLGSKKSSIVRFKGFNAAFPRKTVEDEVRRILRAHFNKLEKANADLERALLGRDRNDKLAWQAIPCPNLKLPARYQGGLLFGQLIPRFDNRIIVRCPITGQKVPTRHCAEFLNFRWGMQLANIRVACGGERWLHPLNVEERKAIDARMREQGSMTEGELKKAVRTNTGCSRDNLDTMLMHPDAKGALLLDPVRKLTKSEKLKTLWPLLPEPVQRRAANMWRRGKAITLLALRDRIETAGSSPAAFDAEVERLLDAANTKKRRKDQPITREELLAEPLVVRPLDGRAAYARRILRQAFEEVMAGKHPTKEGGCLFRSEEIRAAQLQCRVDEQTNNHLVRHRLLILERLQSDIIKEYANRDPARIGRATIEVNRDLREISGKTAKEKAQELGQRLANFKSVTKKLEEAFEGRNVHISPGLIRKARVAEDLGWTCPYTGQRYDPLDLLNAKVDKDHVIPRTERASDSLDSLVITFPAVNKWKDKRTALKFIEDEQGQPVLDMPNLSIKTFAQYEADVKALRPSFDPRPAKRDGRTKGPIDDDLRRWNRKQLLLNVRKWEEKEFLPRDLTQTSQLVRLGAQILKKGFTGLERQPVITSMPGSVTGVMRKGWNLIGCLSAANPNVLDEIGQPKIKTEIRDITHLHHALDACVLVLASYFIPNKGAVWELIVKRRLDETEQLQLRTATRGIFNFSPGRRFGLADLPNSLKEQIRQRLAERRVVQHVPSEMTGLRTEENSWRVVGIENGEALLRQRIRQPDGSRPVKEMRERTEKLIGPEPRNRTGKLKRNKAALIISDNYGVALDPEPTIIPFHNVWKRLAELKQANGGRPPRVLRNGQLIVVPNGKFKGAWKVFSAKNNKSGMALDIGWPDVVRLRNKVEGHKINVLLASLLRSEMRLAKTPLTGMAACPSTSSA

SEQ ID NO: 328 - protein, 829 aa, Unknown
  Description of Unknown: uncultivated organism with predicted taxonomy: Verrucomicrobia bacterium
  MG2-12 effector
MNAKRKNEVAGGTKPDLQLAFDVGHSSLGWAVLQTGEANSFEVSLLGCGVVTFGADDCLASQRRAYRRQRRHSRSTRQRIVRMEKLLLYLKLIEPQQLATKHQQAGGHPAPWLLAARILASNGDPRYLLDWPELWDVIRWYAHNRGYDGNARWANACDRALSDAEQEEKKADTEKEKKADELMENYGKKTMAETVFADLFAPFHLNDPTKVSSLPFFQRRFKANQCAFSRETVEAEVARLLDAHTGNLKGCNKQFIRLLLTRKLMGEDRGMLSEAGIRLPKRFEGGLLFGQLVPRFDNRIIAACPVTGEKVPNKHCLEFLEFRWAMTLANIGVGFGTETYRNREGNESTLRPLTGDERRKVDARARRLGFLKAEPDRPGKDGLVRSGRNELREIVVAATNCDRHNLDTLLLHPDAREGLRLLRVKGDTTAFRVAWGSFGDPLDIQGHYHDDPLRHRFTTQLLRLKKLNLRSILSELERLGKVEVALCLRAAAELQAKGKKVKLDPIKLDGLLDAEFSCDKLKGRARYSRAKLAQAVQEVFNKSEPIHPLQKGGCLEQTNEIKQAALDKPMDQQTNNHLVRHRLLILKRLQEHLFNDYADGDKLRVSRITVEVARDVQTTSGMTNKEKAKELGSKIKHHHETAAWLAERLEDERDENGRRFVIGPSLIRKARIADDLGWECPYTGRKFEPADLIHRRYDKDHIVPRSKRLSDALEAMVITSCEVNREKKNRTALQFIKDMNLPENRAVRERLNIRTEAQFREFVDELKAKGSHADDVRRRKRRKELLLVQKYEEKEFTPADLTKTRFINKLAAQQLQAAFRDLPEQQRPP

SEQ ID NO: 329 - protein, 1083 aa, Unknown
  Description of Unknown: uncultivated organism with predicted taxonomy: Verrucomicrobia bacterium
  MG2-13 effector
MNTTASPDTTSKKSIGDLSLAFDVGHSSIGWAVLQNIDASAPSILGCGAVIFAADDCLASQRRTFRRQRRHVRSTRQRIARMKALLAHLGVLSREQLDQPGCAWPWQLAARALCGGPLLNWSELWDVLRWYAHNRGYDGNRRWSAADIEMLKEDTEKEENAINLMQKNAVTTMAETFCKELGVDPLGSKKSSTVRFKGFNAAFPRKTVEDEARRILRAHFGKLEKVNTDFKRALLGRDTNDKLAWQAISCPDLKLPKRYQGGLLFGQLVPRFDNRIIMRCPITGEKVPTRHCAEFLNFRWGMQLANIRVASGDGRELRPLNVEERKATDAQMREQGSMTEGELKKAVRSVTGCSRDNLDTMLMHPDAKDALLLDPVPKLTKSDKLKPLWPVLPERVQRRAANIWRRGKAITLLGLRERIQMAGGSLATFDGEVERLLDAANTKRRRKVQPITREEFLAEPLVVRRLEGRAAYARLILRRAFEEVMAGKHPKEEGGCLFRSEEVRAAQLQRRIDEQTNNHLVRHRLLILERLQRDIVKEYLGGKSAHIGRVTIEVNRDLREMSGKTAKEKAQDLGQRLANFKNVAEKLEEAFEGKDVHISPGLIRKARIAEDLGWTCPYTHHSYDAFQLLNRTVDKDHIIPRTERASDSLDSLVITFSAINKWKGKRTAMKFVEDEQGNPVPDMPNLSIVTLTHYKAFVEGLDTFRGHDDDKRRKKNRQRLLLVRDYEKPEFTPRDLTQTSQLVRLGAQVLKKGFTGLERQPVITSMPGSVTGVMRKGWNLIGCLSAANPNVLDEIGQPKIKTEIRDITHLHHALDACVLALVSHFIPNNGGVWELIVKRRLDETEQLQLRAATHGIFNFSPGRRFGLADLPDSLKEQIRQRLAERRVVQHVPTEMTGLRVEQNAWRVVGIADGEALLRQRIRQPDGSRPVKEKRERTEKLIGPEPHNGTGKLKRNKAALIIPDNYGLALDPEPTIIPFHKVWTRLQDLKGANNSKTPRVLRNGQLIRVAESAGEYKGIWRVFSTKNAAVGFLVDMGRPDVVRLKNGVEGHKINVRLSSLLKHGVELVRSNYAGMAACPSTLSA

SEQ ID NO: 330 - protein, 1077 aa, Unknown
  Description of Unknown: uncultivated organism with predicted taxonomy: Verrucomicrobia bacterium
  MG2-14 effector
MSLALSFDIGHSSIGWAVLDVKGKDPEIVGCGSVVFPAEDCQNQQRASFRRQRRHIAATRNRIKRLEAFFVASGVLSEKDIWECRRRPHPWPWLLAARTIVSGQTLSGVELWAVVRWYAHNRGYDGNALWAGEDSNQDDVMKVQAARQLMDKCGTETMCETICSLLEADPRSDSNPKPKHYFKGENAAFPRQTVTDEARSVLELHIAKIDGVNEAFVSALVDEWRRAKSAGFDVKLPQRYCGGLLFGQLKPRFENRIIPKCRLTGEKTPSKHSREFYRYRWAMFLNNLRVHDLMTGFSRPLDSNERVKLDGIMREAGYFTKTTLTKALVKELQLEPANLEAMLLLPEMENALTLDPALREVSTNKILKTIWPCVDNVWQRVFLNQLFHERRFRGQPVSLNQWRDRLLSDGKSVEDFDKALQSAFETEASFLWNKKNLKVTFEQFLSRPICLTSKHVASGRAPYSKSKLRAAVDAVMQGEDPRMIGGPLEETIEVGQRQRDKEIDQNSNNHLVRHRLKIFARTLNDLVARYASGDASRVNWFAVEVVRDLVQFSGKTAKEKSQILGQQLWHHRKIVSYLEEERENTNGTWDINAGLIKKVRIADDMGWQCPYTGKTYSLNDIIHGEVDREHIIPRSSRPTDALHALTLTFRQINKEKGARTALQYIEDTRGESHTFSPKEFREFVGGLKNKNGPAKDDEVRCKKRKIALLTPIYERRGKVKQTDTGEEVLEAFTDGTLSQTSYLNKLAVQQANHWFRQQLGLDTKLPLVIQLSGSVTAAIRTGWDLFGQLNEVCPATRNKTKTEVREITHLHHALDAIVIGLSAHYFPRDKRLWSLMSRRAVKNSVDQAYMKQQLGDLVCFNSDGKWKLQELDIGIKKQVAARLSEKRVVRHNPRTMRGLRVQQNVWRVEGEDPQDDSKLLISMRPRNEEGSKGFSKQRSEKKSKLLGPSPNIGSGKLKELKGALIVEDNFGLALLASGPVVIPYIGVWKRIKELTQMNNGVRPEILRNGSIVEIPKQEGKPYKYEGRWLVRGIDNSAQGMRIKFDTVDGVGGIAFKSFINPLLKRGMRILSADLSGE

SEQ ID NO: 331 - protein, 1079 aa, Unknown
  Description of Unknown: uncultivated organism with predicted taxonomy: Verrucomicrobia bacterium
  MG2-15 effector
LRMSLALSFDIGHSSIGWAVLDVKGKDPEIVGCGSVVFPAEDCQNQQRASFRRQRRHIAATRNRIKRLEAFFVASGVLSEKDIWECRRRPHPWPWLLAARTIVSGQTLSGVELWAVVRWYAHNRGYDGNALWAGEDSNQDDVMKVQAARQLMDKCGTETMCETICSLLEADPRSDSNPKPKHYFKGENAAFPRQTVTDEARSVLELHIAKIDGVNEAFVSALVDEWRRAKSAGFDVKLPQRYCGGLLFGQLKPRFENRIIPKCRLTGEKTPSKHSREFYRYRWAMFLNNLRVHDLMTGFSRPLDSNERVKLDGIMREAGYFTKTTLTKALVKELQLEPANLEAMLLLPEMENALTLDPALREVSTNKILKTIWPCVDNVWQRVFLNQLFHERRFRGQPVSLNQWRDRLLSDGKSVEDFDKALQSAFETEASFLWNKKNLKVTFEQFLSRPICLTSKHVASGRAPYSKSKLRAAVDAVMQGEDPRMIGGPLEETIEVGQRQRDKEIDQNSNNHLVRHRLKIFARTLNDLVARYASGDASRVNWFAVEVVRDLVQFSGKTAKEKSQILGQQLWHHRKIVSYLEEERENTNGTWDINAGLIKKVRIADDMGWQCPYTGKTYSLNDIIHGEVDREHIIPRSSRPTDALHALTLTFRQINKEKGARTALQYIEDPRGESHTFSPKEFREFVGRLKNKNGPAKDDEVRCKKRKIALLTPIYERRGKVKQTDTGEEVLEAFTDGTLSQTSYLNKLAVQQANHWFRQQLGLDTKLPLVIQLSGSVTAAIRTGWDLFGQLNEVCPATRNKTKTEVREITHLHHALDAIVIGLSAHYFPRDKRLWSLMSRRAVKNSVDQAYMKQQLGDLVCFNSDGKWKLQELDIGIKKQVAARLSEKRVVRHNPRTMRGLRVQQNVWRVEGEDPQDDSKLLISMRPRNEEGSKGFSKQRSEKKSKLLGPSPNIGSGKLKELKGALIVEDNFGLALLASGPVVIPYIGVWKRIKELTQMNNGVRPEILRNGSIVEIPKQEGKPYKYEGRWLVRGIDNSAQGMRIKFDTVDGVGGIAFKSFINPLLKRGMRILSADLSGE

SEQ ID NO: 332 - protein, 1137 aa, Unknown
  Description of Unknown: uncultivated organism with predicted taxonomy: Verrucomicrobia bacterium
  MG2-16 effector
MKTSHSSPDLELAFDVGHGSIGWAVLQNGSQTQIKGCGVVIFRPDDCLASKRREFRRQRRHIRSTRQRIKRMKLLLAHLGVLTQEQLDKPGCAWPWKLAAQVLVGGPTLTWPELWDVLRRYAHNRGYDANRRWSTIEIDLDEEQEDTEKLKTAEGLLKKHGVRTMAEAFCKELGVDPLGSKCASKVWFKGVNAAFPREVVEAEVRSILRAHFGKLKAVDELLEKALCDDWRAIECPAIRLPKRYEGGLLFGQLIPRFNNRIISKCPITGKKVPSRNCPEFLKFRWAMLLANVKVAGTADRELRPLTVAERQAVDAKMREKGALTAEEFKHAVRTASGCSRDNLDAMLMHPDAHEALLLDPVQRELSRDELIAALFAKLPVRIQKRARGQLRRGKTITLGQLRDQAIALGESVEAFDNELNRLLEAATIRRRRKKDAALTAESVLKRSLYVEKLTGRAPYSREILVKAYEEVMAGKHPAEEGGCLFVTDQMREAQLQREIDEQTNNHLVRHRLKILDRLLRDIITEYAGNDKTRIAKITIEVNRDLREMSGKTAKEKAQYFRLLTADHHRVAEKLKKALAGQTVDGKPIRISASRIRKARVAEDLNWTCPYTGQKYEPIDLVTERVDEDHIVPRSQRMSDSLESLVISFSAVNKWKGKRTAMRFIKEEQGKPVPGLPNLSIVSLNRYLEFVDSLPPRNDPRKLKRHLKLLQPIDDDLRKWRRKELLKLEEYEQEEFTPRDLTQTSQLARMAAQMVKRTFQDVEQKPVIVSMPGSVTSTVRKGWDLLGCLSKACPEVLDETGQVKTKSEIRDITHLHHALDACVLGLAAHFIPNNGDIWKLIIKQDLNETEKDLLRPLGIFDIGEKRFRLKDLPNELKNQLRERLAELRVVQHIPKRMTGMRVDQTVWRVFDPQDQHPSARRLARWFKKAGVNVPAPDADTVLIVCRKRRSQPDSETGKTLHETKTWRWVYQEIAKSKLIGLQPRPGSEGRLKKLKAVKILADNYGVALDPEPQIIRFHKVWPQLNELRQKNGSKPVRVLRNGQLIRVPRGTYAGIWRIVSTKSTEAFGLALDLALPDRVKLTRGNVPIKRLIEDGLEVVDCPYTGVDASKIEFAPVKKRPRKSKTAPAETTTPPSSSA

SEQ ID NO: 333 - protein, 1471 aa, Unknown
  Description of Unknown: uncultivated organism
  MG2-17 effector
MGNRADLELAFDVGHSSIGWAVLKTQPELEMKGCGTVIFRPDDCLASKRRDYRRQRRHIRSTRLRIERMTNLLLGIGAITQSDVESGKKQHKGEPPPWLLAARVLAARTETEKAKALLTWPELWKVLRWYAHNRGYDANVRWSGESKVEAFSPSPQINTEDVEEQAVEAEESELADVEVAEDSDSDSDKLRAGKHLMSSKYGFHTATFAETVAKILLGPKRDVKPGQAGKTGKLAETTESFSESDFRKLLFDTPTESWSHPRHLSIYFKGIRAAFPRRIVKVIGGQRTLVGGTEWEVRAILRAHFDAPKGKALCDETFEAAICGRLPETREDWRAYAETHPTLYLSSDDQAKLRSLRAPPKASQEKSERIRQQRRNILTGKLFLPSRYEGGLLFGQLGTRFFNRIISRCPFSFARIVAAILSGDENTLRLYGTTLAAVNRSRHSRNGVMETDLDLARRWAAKLSKVPAAKSREFLLYRWAMTLANVIVARPGRERLTGYERRCIHRRLRRTGYFTKDSFKEAVRQTTGCEPANLDQMFDTTTEAENSLFIDPVRKYLATNEVAGVVLPVLSQFLQVRLARLLQKGKGVRVREIAEWLDETAKRELSQRIEQYVQENNAKAKAAKKKPHDTHSPDEDRRKKQNKLTAAAVLRVRLEAPLPKGRASYHRVVLRKAVAEVLKGFDPRKPKRDRSNPDGENKPSHGCLFRTPETNRQLLGNPNNEAEYERWKQRWLSHQKNYQRYIARERLSPGSGEAFVRSEYHAAQSYRWLASQSNNHIVRHRLTILDRLLRDIIADQNYCAGDPKRIRRISIEVANDILTFSGLERKQLSGQVMPSLREHHDHVVRLLQQELKGTQWENKIDGELIWKAKIADDLGWWCPYTGKKYSPCELASGEMDVDHIIPKSRRLTNAMSAVVVTFKTINNLKGDLTAWEFVERYQDQPVGPHGEKVRKLWDYERFVKNPDNEMDKPRLSGETGHSDYPRWPKYLPGSRRKLHPDYVRRKLRRRYLLLKHYEKDKDTFTPRDLTITSHLNRLAQQVLLRSLPHLAEHQITAIPGSVIGVLRDAPGWRLLGCLDGAATADVIRKVLQLDHEGKPMCASDVAPLMKRIPKPKGEIRELTHLHHAVDACAIAIINHLLPKDGKLWELVAKRELTDADKNAYDDLRQKNQSQWQPRRLARLFSIVPNLDDKGQQPKHDHKWRIRPCRLKDVLPDIGAQVNKCLRERRVVEHTPADMSGLAAEETVWRIFDPSDNHPSARRLKQWFEKKIKDGEIQKLPDPTNEADKTVLIVCRKRRDAKSNDKGKTLHDTGNVWRWVYDEVNKVRVVGLNPGKLHRIKAVKLIRENFGIALDPEPTIVPFHKVWQRLMELKAKNGGKMPRVLRNGQLIRVLSGSRAGLWRVTSVKQTEAYGLVLDLAYPDSVHLSRPNAPVEQLLKEGLEILKHSLTGYDASVVAYAPVKRRPRKPKAAQSEQ

SEQ ID NO: 334 - protein, 1003 aa, Unknown
  Description of Unknown: uncultivated organism with predicted taxonomy: Verrucomicrobia
  MG2-18 effector
MKTLLRHLGALTQEQLDKPGCAWPWKLAAKVLVSNGAHTLSWPELWDVLRWYAHNRGYDANRRWSGAEVDAQEEQEDAEKLKTAKNLLQKHGVQTVAETFCKELGIDPLGQKSASTVRFKGLNAAFPREIVEEEVRRILRAHFGKLKGVDENLERALCGRDSRDKDAWQAIPCPDIHLPERYEGGLLFGQLVPRFDNRIISKCPITGQKVPARNCREFLEFRWAMQLANVKVAATGNGPLRPLTADERRQVDTKMREKGALTPTEFKEGVRVATGCVRDNLETMLMHPDAREALTLDPVQKALTSDERIAALFAKLPARIQKRARGQLRRGKTITLGQLRDHALAVGESVTDFDEELGRQLNAAAAKKRKKDAGISRESLLARPLHVEKLSGRAAYGREILRKACEEVMAGKHPKEEGGCLFVTEQVRQAQIQRDIDQQINNHLVRHRLKILERLFHDIIAEYAGGDKSRIGRITIEVNRDLREFSGKTAKEKAQDLGLRIADHHRVAEKLQKALAGQTLNGQPIRIGPALIRKARIAEDLGWTCPYTGQKYEPIDLVTRRVDKDHIVPRSQRASDSLDSMVITFSAINKWKGKRTALKFVEDEQGKPVPDLPNLSIVSLSRYRDFVEKLDTFKGHDQDKKRKKRRKALLLVRDYEEEEFTPRDLTQTSQLVRLGAQMLKRPFLREKHQPVITSMPGSVTGEVRKGWNLLGCLSKACPQVLDENGEVRTKTEIREITHLHHALDACVLGLAAHFIPNNGRIWELIVKRNLTDTEKLQLRALGIFDFSPEGFRLKELPDELKNQIRERLAERRVVQHVPKRMTGLRVEQNAWRVVKIEGDEAIIRQRMRQPDGSRPVKETTERVTKLFGLNPVGGSGKLKALKAALIIPENFGIALDPEPTIIPFHKVWPRLQELKKANGGKWPRVLRNGHLIHVPKGRYQGTWRVFSAKNNKSGMAVDMGWPDVVRLRNGVQGHKINVLLASLLRDGMTILDTPLTGVASPVR

SEQ ID NO: 335 - protein, 1125 aa, Unknown
  Description of Unknown: uncultivated organism with predicted taxonomy: Verrucomicrobia
  MG2-19 effector
MQEKILSTKDGGKNLEVSFDVGHSSIGWAVLKSPDKNGENNPEFPQIELLGCGVVTFEPDTCLAKKRRDYRRQRRHIRSTKMRIKRMKQLLEHLKVLTPSELEKPGSPYPWKLAASVLQGKHLLNWNEIWDVLRWYAHNRGYDENRHWSEVAEKDKDDTESVKKSIELMKEHQTKTMAETICKELGTDPSESDKRASHKSYKEVGAAFPRSVVVNEVREILDKHIGKLPGLSQELVETLVGESKDAWKTIPCPSINLPSHYWGSLLFGQLLPRFNNRNIKKCPFSGDTLPLKECVEFYRYRWGKILTNIRVSANGLFGQKRPLNPEERKYVDSKMRELGSMTETELQKAVEEAVLMTLNKEGILKPGKINTNLETMFLTPEMEKGLVLDPVKNLINSDTVQSFWGVLPPQLQKRLTGKWRRGKQIKIGEIQKELEKIAPEKVEEFISTIKKNLKGKNKNQNYLEIKIPDSPLKQLKGRAPYGRKLLQQAYEEVLEGKDPHEKGGCLYRAENILKEEIQEDIEKQTNNHLVRHRLLILERLFDDIVKEYAGNDKNKIKLITIEVNRDLREFSGMTAKEIESELNARSADFKKAKKQLEDMLLKAGLSNTRITATLIKKARIAQDLDFTCPYTGAKYELIDLINKQVDLEHIIPKSKRPSDSMESLVITFKEVNRWKGNRTALRFIKEEQNKPVQGKGNLMILTEKRYQELVNGLNTKGHPKDTERKKKRKELLLMEDYVEEEFLPRDLTQTSQLVRLAVQVLKKKYIGEKEKPVFVSMPGSITGKFRAAWNLLGCLLKAVPWAADEDNQVKPKDELRNITHLHHAIDACVLALAGHFIPTYKNGKVWELMIKGTVKPSEKSYIEDVPMLQLDSENRLHIKDLPDSIKEQITERLYERRVVQHIPKDMSGVKCDETIYRVVDPNDNHPYAKKLIRWAKEKDIQIPSADDDTALIVAKKRRGADGATGSKILHEGKKYVWQYDIVRKTKLLGIEPIGGNGKLKRLKAAKLIGENYGIALDPKPQIIRHFKVYQTIRELKKLNNGKPPRILRKGSIINVPKGRYKGVWKITSIKDSKDEIKVNILRPQAVKNVGKTNYSKGDVLLRTLIKNGMQVIEAPYTGVNVALYS

SEQ ID NO: 336 - protein, 834 aa, Unknown
  Description of Unknown: uncultivated organism with predicted taxonomy: Verrucomicrobia bacterium
  MG2-20 effector
AARQHLTELAARQGAFTKGEFKKAVREAAGWPEKGGHDNLDALLLHPDAEEALVFDPVQAALRKHPLAEAFLTLPPQFLKRLRGKLARGKSVAPGTVRDWLSRAQAPPPSASDPLAAFDAAIQRVLDAANTRKGRKQSALTREQLLEEPLRATYPKGRAPYARPVLRQAYEEVMKGWDPRAEANDHQPRGCLCQTDELKEAQLQRRLEEQTNNHLIRHRLLILGGEQPKPNATPEHERRRLKGLLHDLIQDFANGDKSRIASLTIEVNRELRDLSGKTRKEQEQDLGLRLGDFKRVAAKVEEACRRRGIPCTAGLIRKARVAEDLGWKCPYTGKEFSVDTLLDGVMDKDHIIPHADRQSDSLDSLVITWNEVNKWKGKRTALEFIREEGGKPVPGRPELTVMTLAEFQKHVASLDIRKGHDDDRARKKRRIRRLLTEYYEEKEFTPRDLTVTSHLVRLGAQVLQRAFPPEQRPPVISLPGSVTGEVRKAWKVTACLEAANPAVMEVVEEPDPQTGEMRRIRRAKKKEDIRGITHLHHALDACVLGLASLYFPRHGAVWSAAVKAGQHAATEYDNNEHPLWQAMTKRRPTAQEVVLLKATGLYDGPDSNGRMQLRDLPAELKGQIRRRLAEKRVVQHIPADMSGVKVEENTRGVVAVKDGRVILRQRSARDAKTGLQAVKTTDEAPGKLLGLNPPGGDGKLKRQKGVRVITDNFGVAILDHAPEGEEKFVVIPWHRVWHRVEELKAANGGQRPRLLRNGMLIRVAGLPGKMASKNGVWRVFSVKQTKKLDLGGPDRVAMEDKGLGVWREVSLETLTPARIAILRHGLAGGPQPDP

SEQ ID NO: 337 - protein, 1129 aa, Unknown
  Description of Unknown: uncultivated organism
  MG2-21 effector
MQEEILNTSDVSKNLEVSFDVGHSSIGWAVLKSPDKNKMNNPEFPQIELLGCGVVTFEPDTCLAKKRRDYRRQRRHIRSTKMRIKRMKQLLEHLKVLTASELEKPGSPYPWKLAASVLQGKRLLNWNEIWDILRWYAHNRGYDENRHWSEVAEKEDEDDTESVKKSIELMKNHQTKTMAETICKELETDPSESDKRALHKSYKEIGAAFPRSVVVNEVREILEKHIGKLPGLSQELVETLAGESKDAWKTIDCPPIKLPSHYWGSLLFGQLLPRFNNRNIKECPFSGDTLPLKECVEFYRYRWGKILTNIRVSADGLFGQKRPLNPDERKYVDSKMQELGSMTKTELRKAVEEAVLMTLNKEGVPQPVKINTNLETMFLTSEMEGGLVLDPVKKLINSDTVQSFWGVLPPQLQKRLAGKWRRGKQITIGEIQKELEKIAPEKVEEFNLAIKSNIKRKKKTENHLNDKIPESPLKMLKGRAPYGRKLLQQAYEEVLAGKDPHEKDGCLYRTENILKKEIRKAIDKQTNNHLIRHRLLILERLFDDIVKEYAGNDKNKIKLITIEVNRDLREFSGMTAKEIESELNARSADFKKAKKQLENMLQEAGLSNTRITATLIKKARIAQDLDFTCPYTGAKYELIDLINKQVDLEHIIPKSKRPSDSMESLVITFKEVNRWKGNRTALRFIKEEQNKPVPGKENLMILTEKRYQELVNGLNTKGHPKDTERKKKRKELLLMEDYVEEKFLPRDLTQTSQLVRLAVQVLMKKYIGEKEKPVFVSMPGSITGKFRAGWNLLGCLLKAVPWAADEDNQVKPKDELRNITHLHHAIDACVLALAAHFIPTYKNGKVWELMFKGTVKPSEKMYIEDVPVLQLDSENRLHIKDLPDSIKEQITERLYERRVVQHIPKDMSGVKCDETIYRVVDPNDNHPYAKKLIRWAKEKDIQIPSADDDTALIVAKKRRGADGATGSKILHEHKGKTKYVWQYDIVKKTKLLGIEPVGGNGKLKRLKAAKLISENYGIALDPKPQIIRHFKVYKTIQELKKLNNGKPPRILRKGSIINVPKGTYKGVWKVISIKEGYSEIKVDILKPQAIKIVDKTDYCKREVLLRTLITSGMQVIEAPYTGVNVALYN

SEQ ID NO: 338 - protein, 1471 aa, Unknown; identical to SEQ ID NO: 333
  Description of Unknown: uncultivated organism
  MG2-22 effector

SEQ ID NO: 339 - protein, 778 aa, Unknown
  Description of Unknown: uncultivated organism with predicted taxonomy: Verrucomicrobia bacterium
  MG2-23 effector
MQLANVRVAGSGNGQMRPLTADERRRVDAKMREKGALTPTEFKDAVRSATGCVRDNLETMLMHPDAKEALTLDPVQKLLTSNECIAALFAKLPARIQKRARGQLRHGKTVTLGQLRGYALAVGESVADFDEELQQQVDAAATKGRKKVAGVSRESLLAQLLRMEKISGRAAYSREILRKACEEVMAGKHPKEEGGCLFVTEQMRQAQIQREIDQQTNNHLVRHRLKILERLFRDIIAEYAGGDKSRIERITIEVNRDLREFSGKTAKEKTQDLGLRVADHHRVAEKLQKALAGQTVNGQPIRIGPGLIRKARIAEDLGWTCPYTGQKYEPIDLVTRRVDKDHIVPRSQRMSDSLDSLVITFSAINKWKGNRTALKFVEDEQGKPVPDLPNLSIVSLSRYREFVEKLETFKGHDDDKKRKKRRKALLLLRDYEEEEFTPRDLTQTSQLVRLGAQMLKRPFLGEKHQPVITSLPGSVTGVVRKGWNLLGCLSKACPQVLDETGEVRTKTDIREITHLHHAVDACVLGLAAHFVPNNGRMELIVKRNLTETEKLQLRALGVFDFSPDGFRLKELPEGLKNQIRDRLAERRVVQHIPKRMSGLRVEQNAWRVLKIEGDEATIRQRVRQPDGSRPLKETTERITKLFGLNPTGGSGKLKALKAALVIPDNFGIALDPEPTIIPFHKVWPRLQALKKANGGKWPRVLRSGQLIHVPKGRYQGTWRVFSTKNNKSGMAVDMGWADVVRLRNGVEGHKINVLLASLLRDGMTILDTPLTGVASPPL

SEQ ID NO: 340 - protein, 1074 aa, Unknown
  Description of Unknown: uncultivated organism with predicted taxonomy: Verrucomicrobia bacterium
  MG2-24 effector
MTAKQNLADLHLAFDVGHSSIGWAVLRHTPPPALPEILGTGVVIFGADDCLASKRRQYRQQRRHARATRKRIELLARFLFHRLQGETDPATTQFREHLKPYLEQTAATRQLQGDGDSFAWQRAAEILTAARENKPLPDLGWSELWDILRWYAHNRGYFAPPWANRGDESAAPDTDDEVSDTEKVEHANDLMRELGTRTMAETVAAYTARYEREAAEWQQGRRKEKPKHFKGLNAAFLREKIVWPEVCALLTALKGRLPGLDDAFIRTLLGNDVDPLRDRDAWRTIPCPDIQLPKRYHGGLLFGQVIPRFENRIIGVCPIWFSVCQDLCLHHPEITQDDPLRREKEAVVQAFEQWLPRAKKANERLSPEKQKSPEALIAEFAAKQSKLPAKASPEFLRFRWAMQLANVFGAAPGERETRPLTADERKQLTARAEKQGAFTKGEFKQAVREIAGWLEQSSRDNLDALLLHPDAEQALIFEPVQAALRKHSLAEALLALPPQFLKRLRNKLTRGKEVKPQAVRDWLGGAQASTPSASAPLAAFDAEVQRVLEAAATRRAKKQTALTRDTLLAQKLCATYPKGRAPYARPVLRQAYEEVMQGWDPRAEKRADQPRGCLCQTDELKEAQLQRRLEEQTNNHLIRHRLLILERLQRDLIAAPEFANGDKSRIAGMTIEVASDLRDLSGKTRKEQEQDLGLRLGDFKRVAAKVEEACKRRNLRVTAGIIRKARVAEDLGWRCPYTGKEFCIDTLLDGVMDKEHIIPHADRQSDSLDSLVITWNEVNKWKGKRTAMEFIREEGGKPVPGRPELEIMSLAAFQKHVASLDTRKGHDDDRARKKRRIRRLLTEHYEEKEFTPRDLTVTSHLVRLGAQVLQRVFPKDQRPPVVSLPGSVTGEVRKAWRLTGCLEAANPAVMEEVQERNPDTGELQTVRRPKKKDEIRGITHLHHALDACVLGLASLCFPRHGAVWSAMVKAGGDREADDDRRLWLAMTKRRPTPQEATLLKATGRYQQDSEGRLHLADLDEQLKQQIRARLAEKRVVQHVPADMSGVKTEENTRRVLRVREDGRVELRQQAPRDA

SEQ ID NO: 341 - protein, 1337 aa, Unknown
  Description of Unknown: uncultivated organism
  MG2-25 effector
MGTPTLSSDPNAKLELAFDVGHSSIGWAVLRPVAADVRRLTSTPAKESSQSLVTSAATGIELLGCGVVTFGADDCLASKRRDYRRQRRHARSTRQRIARMEKLLAALNVIPKAELERLHSQAKGHSKQNPHERKGASAPWLLAARVLAARTEEERKKAELDWPELWDVLRWYAHNRGYDGNIRWSGGFRVEAFSETPQVSVSALTEQVDKAKQNEDDPDEDWKKLESAAKRMADYGFTSPTFAEMVAKYLLGPDRTLKPAQPGKPAEVEPTKASFTEADLHKLLFHCEPGFEHHPRHLSNYFKGLRAAFPRRIIKDIDGKPTLVGGTEWEVRYILRAHFGTLTGCDARFEQVVCGGIPEAETDWLALGELLPALYLSDDQKRQLKALRIPKDAFAGDKPGRKREKERLRFLRTAITRDKLVVENRYSGGLLFGQLVPRFDNRIITRCPISGDKVPVKQSPEFLRYRWAMQLANIQVAASAQEKLRKLTADDRAALHKLMQAKGALTEGELKKAVRALPGVARDNLDTMLMHPDAKDALIFDPVQKLLASDELAPFWATLPANLQARFRGKLRHAKAITLADLRTALPDPKAFDVELQRQLDAQNTRKAKKQPAFSRDQFLAQSFDARKALARLSGRAPYARPLLQQAYEQVLAGKDPREEGGCLFRSEEIRQRELHKKLEDQTNNHLVRHRLLILERLLKDLVNAPEFAAGQPERVAQVTIEVNRDLREFSGMTRKAIEMDLGSRLKNFKSVSDKLEKAFDSQTYNGKPVQVTAGLIRKARIAEDLGWQCPYTGQSFEPVHLVSRAVDKDHVIPRSQRPSDSLESLVVTFSEVNKMKGQRTAWQFIQEFGGKPVEGMPNLMIRTPKQFEEFVTKLESFKGHEDDKRRKKRRKDLLLLPKFEDKGFVPRDLTLTSQLVRLGAQVIKRFFAGGARVNNPREAPTDSTARGFVNPRSGPRITSLPGAVTGAVRKGWRVLGCLAQAAPQILEPTGEPKSKTDIRDLTHLHHALDACVLALAAHYFPKDGSLWEAMIVRAPNAAQKQLLHATGFYEFIAEDKPNLKDLPIELKQQIANRLAEKRVVQHIPADMSGMKVEENTRGVVKVENGRATLRQQKRNAEGKLEVKETEEVVGKLVGLHPEPKREAHPSPALRAPSPLAGRGEREESNDAAAGSPPSPFAQRGERDGVRGAAQGKLTPMRGVRVITDNFGVAILDHASNPDDRFVIIPWHKVWHRIEALKEKNGGQPARVLRIGTLIRVPNKSGRSDYRGTWMIRGAQLNQNAGMLVDLSNPDVITYRVSGRKDCKQNVSLKSLVEGGLEILKPSLCGVAQTAQAMAPG

SEQ ID NO: 342 - protein, 853 aa, Unknown
  Description of Unknown: uncultivated organism with predicted taxonomy: Verrucomicrobia bacterium
  MG2-26 effector
QRLAKGASAAEATAHARKLAKVPSRNCPEFHRFRWAMQLANVQVASGRSPELRPLTVPERRQVHARMLQRGFLTAAEFKKAVREITGATRDNLDQMLMHPDAQEALILDPVRRLVTTSPILEAVWPQLPEAAQKRAAGQWRRGKTLTLQDVVRHTNAAERARIEAAVKNHLDLENTRRKKKDKTLRADEIMTQPLSIKRLSQRAPYTRVVMDEVWADVMERGLHPKEKGGCLYRDEAIRQAQLQREIDEQTNNHLVRHRLRILERLHRDILQEYAQADPARVARVTIEVNRDLRELSGKTRKEQEQDLGQRLANFKSVVRKLEESFDGKKVKITPGLIRKARVAEDLGWTCPYTGKAYDAFDLLNRAVDKDHIIPRSQRASDSLDSLVITFAEVNKMKGKRTALRFIEEFQGQPVPGAPRLSLRTLRDYQQWVEGLETFKGHPDDQRRKKQRKKLLLLPEYVEKDFVPRDLTQTSQLVRLGAQVLQRAYLGLARPPVVTSLPGSVTGTVRKGWDLLGCLATANPGVLDESGEVKNKTEIRDITHLHHALDACVLALAARAIPNNGRVWELLTRRDNGLNEVERQQLLALGIYARDSEGRLVLRDLSPDLNEQVRQRLAERRVVQHIPSDMTGLAADQTVWRVFDPADSHPSARRLARWFKEAGVKVPPAGADTVLITCRKRRSQAGAETGRLLHQSPTWRWIYQEIPRSKVIGLEPRPGSPARLQRLKAVKILGDNYGLALDPEPQVIRFHKVWSQLQELKRRNEGKPVRVLRNGQLFRVQNGRYRGIWRVFSTKDNSSGMALDMGYADVVRLRNKTEGHKINVLLSTLLRDGLCILQSSYIGVSTCPTTSSA

SEQ ID NO: 343 - protein, 1016 aa, Unknown
  Description of Unknown: uncultivated organism
  MG2-27 effector
MASLEFSLDVGHSSIGWAVFQSDPFQPLGAGSVIFGADDCLAKKRRDYRRQRRHIRSTRQRIERMKQLLSHVGFLTREQLDQPGTAWPWLKAAEVLKPEGGVKLSAQELWDVLRWYAHNRGYDGNRAWARDETEAQEDTAREQAARQWMQDHNTQTMAETVCAVLDVGPGKRSDGGDKRSSNLRFKGRGVAFPRSVVTSEVRHILENHQGKLPGLDSRTIRILMDDARHENLAAEAGIRLPHRYEGGLLFGQLIPRFDNRIISSCPVTYEREYARALDEGKSEDEAKHQAVRQAKVPAKKSREFLLFRWAMILANVQVADASGTRPLSVEERQSLHQLMVKSGKLTKREFLKTLDATVGSPRHNGSALLMPPDADKALVLRPEKDALKRLSGRAPHARVVMKQAVKDVFAGRHPMAEGGALFRSEELRALQLRRTVEEKTNNHLLRHRLLILRRLVKDMLATYAGNDPSRISQVTIEVNPDLRSFSGMTAEEKKQEMGQRLGDFKKVVQKLRGDLPEVTAISAGLIRKARIAQDMNWTCPYTGMEYDALDLLHGHVDKDHIIPRSLRPSDSLDSLVLTLRTINEMKGQRTAVQFIKEFEGREVQDGKKRSLEILPWSQFQKLVESLDAKGIHDQDRARKKRRKALLLQEHYTEKEFVPKDLTQTSHLVRLAAEELKKEFGGVQCSTRIVSMPGSVTAETRKAWKLEACLAQANPEVAELRERRKTEPAPVSIKQELRDISHLHHALDACVLACAAHYLEKKGNIWKALVQRRKSEAENLELLSTGLFKRGQDGQARLQDLPAQLKNQISRVLAECRVVQHIPSNRRGLKAEETVWRVLDSEDHHPSAEKLRKWAQLAQVELPNPDSGKVLLVKRIRHTAAGAKAPKNLLHQGSEFWWAYEVVALSKLVGPGASGKLRKIKGAKQIGDNFAVTLGPKMEVIPHHQVQERWKGLGCPRYLRNGQIIEMPTGKYSGAWKVFSIKNARQGILLDIARADSPRAKQGNPGTRINVLLKTLV

SEQ ID NO: 344 - protein, 1081 aa, Unknown
  Description of Unknown: uncultivated organism with predicted taxonomy: Verrucomicrobia
  MG2-28 effector
MTTQRNSSPNASRKFGGQLAFAFDVGHSSIGWSVLTAPERDHPEILGCGVVLFEKDSALACQRRQHRRQRRHIRATRQRIARMEKLFMHIGALTREVIESKHRAGGGNSAPWLLAARVLASNGQKTLSWQELWDVLRWYAHNRGYEPVSDEAEADKEDIEKVENAKREMGRLGTVTMAETITAWLGLDTFGKRAASRENYKARNCAFDRGMVVAEVRRILEAHVDRLPGLDERVVKAILDDVHAIEVPSIRWPRRYRGGFLFGRLATRYHNRIIGKCPISGAKLPKKRCREFLCYRWAMLLANIRVVDSDDGRSRPLSREERSNIHKSMERKGYLTPGDLKRLVGTLPGVKQHNVDQIVVHPDAGEALVFDPIRKLIVSNERVAAVWETLPPQVKKRATGKWRRGKSLNLAALRAEVVELGHDVSGFDSAVTTFVSSRQKTRRRSRTHSKETVDDIIEAPIDARRDLAKLSGRAPYARQLLDQAFKEVMDGKDPRARGGCLEETEEVRRRREERPIAEQTNNHLVRHRLQILGRLLNHLIEDPAYGANRPERIRRITIEVNRDLREMAGRTSQEIAKELGARVANHKKVANRLFGELPEGTRITGSLIRKARIADDLGWRCPYTGVEFEPVDLVEGRVDRDHIIPRSQRMSDSLDSLVITFSAVNKWKGQRTAWQFIQEEGGKPVPDAPNLSIVTPARFRDFVEHLDTKGHRDDYRRKKRRKELLLLERYEERTSGFTPGQLTQTSQLARLAAQILRTPFNDTSNPPEIVSLPGFVTATVRRSWDVLGCLSQAAPGVLNTDGSTRSKTEIRNITHLHHALDACVIGLASHFIPNRGDVWRLLAQRNLRAWEKQQLADLGVFDFDAHGGLRLRDLPQQLKEQLRQRLTERRVVQHVPADMNGMRVEENTRGIVRREDGRVYLRQKTLTSDGRRNVKNSDELDIMVVGLNAGGKLAELKGIRVVKENFGVAILENTSLPSGDRFVIIPHVRVWKQLQELRMRNGGKPPEVWRKGQIVRIPSGNREGKWRIFSVMASNRGIMLKLDRPDSPSFDDSGGASGFKMTLTSLIKRGTIRLETRLTGS

SEQ ID NO: 345 - protein, 1026 aa, Unknown
  Description of Unknown: uncultivated organism with predicted taxonomy: Verrucomicrobia bacterium
  MG2-29 effector
TVTFESDGCLASKRRVHRGMRRNIRSRRLRIADIEKLFVHQGILSADQIAEKHKPGAGSSSPWLLSAAVLASGGTFVLNAEELFDVVRWYAHNRGYDGNRRWAHNAEDDDGDSDREKAAFSLMDAHHTSTMAETICAQLGLMPGGQKKASMAPYKDSDIGAAFPRKTVVAEVVRVLEAHVGKIEGCSAEFIEALCGENDGAWKTIAVPNLGKPKTFKGGLLFGQKVPRFDNRILPFCPVTNKPTPLKSCIEFMEFRGAMFLSNVRVGSGDGFELRPLSADELNVVWDKIHKKGYLTSRQFKDEIRGLEGVEKDNLQALMTIDSADKNLVVDPALKLISSSTVLKPVMSLLSEASREELLSNLRRKHGVTISEMISDLSISEELTKAIDTSFKKESKKKREKYGTQERWLSERVFSAEFDSGRAPYGRLVMKQAVEEILSGKDPRAKGGCLYLTDEMQKRQESRSLESLTNNHLVRHRLLILKRLFNDMVKEFCEDDKGRILSVVVEVNREVSSMSGKTMKLIKMEEGLKRSDHKKASKIMEAAVEESGENIRVGAGLIRKARVAQDLDWTCPYTGEKFDPLALIHSQVDLDHIIPRSERLSDAMAGLVVTFSEINRWKGARTAYQFISEEQGKQVPGKPNLSIMSLKAYEDFVGKLKISGGHDSDVGRRKARKGYLLLASYQDKEFTPRDLTISSYVAKLAVGQIKKEFSELSKKPPVISLPGRLTGEARKSWKLLGLLSAVNENITSETPKNDIRGLTHLHHAMDAAVMGLMAHCADNLSDGTSWQLLLKRNLRPEEKNLLKANMRNIGFDGNRAHLLDVPNEIKEQLRRCLLERRVVQHVPSSMEGLKVEENTRGIVAFNEERKKVTLRQTGNETEEVSGKLLGYKTEGSKLADQKGVRVINQNFGVALTHPPQIITWHKVYPKLKKIEQETGRWPQVLRNGMLIHVPEGNYAKASKIWKIFSLKNNASGMAVDMGYADSVKPVKINVLLKSLIKDGLQIIGSDFSGEGICHITSSTLEAQPSD

SEQ ID NO: 346 - protein, 1065 aa, Unknown
  Description of Unknown: uncultivated organism with predicted taxonomy: Verrucomicrobia bacterium
  MG2-30 effector
MKKRDLIFSFDEGHSSIGWNVIQETEAGPNVLALGTVTFTADGCLASKRRIFRGQRRTVRSRRQRIEDIEKLFIHQGILSETQAKEKHEQAGGNACPWLLASAVLASNGKFTLNEKELFDVIRWYAHNRGYDGNKRWAGSADDENKEDSAKEEVAIDLMKNLSTQTMAETICAQLGLQPNGHKKASMKKYKDAGAAFPRKIVEKEVFKILQAHVGKIAGCTETFIETLCGENDSAWKKIPVENIKKTKTFRGGLLFGQKIPRFDNRILSFCPITDKPVPLKSAKEFMEFRCAMFLANIRVKDVIASEMRSLSKNELHIIWELIKEKGYLTASEFKRAVRSLGKFSQDNLDGLMIITESATNLIIDPVQKLIHSNQILSVLWSEIPDFIAKECLFQLGKKRSITLSEIISKMEENLSEGFVTALDKAYKKVQKKNPDKQQWLERKNYRASFDKGRAPYGRDIMKKVVLEVLGGKDPREKGGCLYITEEIREKVNHRKLDELTNNHLVRHRLLILNRLFDDMVDDFADGDKERIKTVVLEVNREISELSGKTTKEIKKEEGLKRAEHKKAREKMEAAVKDSGENIVITAGLIRKARIAQDLNWTCPFTGKEYDPIDLIHKQVDLDHIIPRAERLSDSMGGLVVTFSEVNRMKGKRTAWQFIQDEQGKPVKGKPVLSIRTMKNYETFVSKLKTFGGVKSDEARRKMRKQFLLMPDYKEKGFTPRDLTLTSYVTKLALQQIKNQFDTCRKKPQVIALPGRLTGETRKTWKLMGLLHVVNEKIDGKTLKNDIRSMSHLHHAIDATIMGLLAYYIKDLADGTTWQLLLKRYLTASEIQHLKDNLNHFKIDSKNRAHLCDIPSHVQKQIEQCLKERRVVQHVPSNMGGMHVEENTRGIVGFDSEKGKVLLQQKKDGLKNITTEVAGKLLGYDAEDGSKLKKQKGVRVINKNFGVALTQSTPEIITWHKVYPKLSSIYKRDGVWPNVLRNGMIVYIPDGNYAKVSKVWRILSIKNEKRYMAVDIGFPDSCKSVKRSVNLTTLLKDGMKIVYTKLTGDGICHITSSKSIAPPFD

SEQ ID NO: 347 - protein, 1062 aa, Unknown
  Description of Unknown: uncultivated organism with predicted taxonomy: Verrucomicrobia bacterium
  MG2-31 effector
MKKRDLIFSFDEGHSSIGWNVIQETEAGPNVLALGTVTFTADGCLASKRRIFRGQRRTVRSRRQRIEDIEKLFIHQGILSETQAKEKHEQAGGNAYPWLLASAVLASNGKFTLNEKELFDVIRWYAHNRGYDGNKRWAGSADDENKEDSAKEEVAIDLMKNLSTQTMAETICAQLGLQPNGHKKASMKKYKDAGAAFPRKIVEKEVLKILQAHVGKIAGCTETFIETLCGENDSAWKKIPVENIKKTKTFRGGLLFGQKIPRFDNRILSFCPITDKPVPLKSAKEFMEFRCAMFLANIRVKDVIASEMRSLSKNELHIIWELIKEKGYLTASEFKRAVRSLGKFSQDNLDGLMIITESATNLIIDPVQKLIHSNQILSVLWSEIPDFIAKECLFQLGKKRSITLSEIISKMEENLSEGFVTALDKAYKKVQKKNPDKQQWLERKNYRASFDKGRAPYGRDIMKKVVLEVLGGKDPREKGGCLYITEEIREKVNHRKLDELTNNHLVRHRLLILNRLFDDMVDDFADGDKERIKTVVLEVNREISELSGKTTKEIKKEEGLKRAEHKKAREKMEAAVKDSGENIVITAGLIRKARIAQDLNWTCPFTGKEYDPIDLIHKQVDLDHIIPRAERLSDSMGGLVVTFSEVNRMKGKRTAWQFIQDEQGKPVKGKPVLSIRTMKNYETFVSKLKTFGGVKSDEARRKMRKQFLLMPDYKEKGFTPRDLTLTSYVTKLALQQIKNQFDTCRKKPQVIALPGRLTGETRKTWKLMGLLHVVNEKIDGKTLKNDIRSMSHLHHAIDATIMGLLAYYIKDLADGTTWQLLLKRYLTASEIQHLKDNLNHFKIDSKNRAHLCDIPSHVQKQIEQCLKERRVVQHVPSNMGGMHVEENTRGIVGFDSEKGKVLLQQKKDGLKKITTEVAGKLLGYDAEDGSKLKKQKGVRVINKNFGVALTQSTPEIITWHKVYPKLSSIYKRDGVWPNVLRNGMLISVFSGRYAGIWRILSIKNNATGINFSIAKPDAIAPFKQNVLLKSLMSAGLKKVETKLTGDGICHITSSKSIAPLFD

SEQ ID NO: 348 - protein, 1062 aa, Unknown; identical to SEQ ID NO: 347
  Description of Unknown: uncultivated organism with predicted taxonomy: Verrucomicrobia bacterium
  MG2-32 effector

SEQ ID NO: 349 - protein, 789 aa, Unknown
  Description of Unknown: uncultivated organism with predicted taxonomy: Verrucomicrobia bacterium
  MG2-33 effector
MKKRDLIFSFDEGHSSIGWNVIQETEAGPNVLALGTVTFTADGCLASKRRIFRGQRRTVRSRRQRIEDIEKLFIHQGILSETQAKEKHEQAGGNACPWLLASAVLASNGKFTLNEKELFDVIRWYAHNRGYDGNKRWAGSADDENKEDSAKEEVAIDLMKNLSTQTMAETICAQLGLQPNGHKKASMKKYKDAGAAFPRKIVEKEVLKILQAHVGKIAGCTETFIETLCGENDSAWKKIPVENIKKTKTFRGGLLFGQKIPRFDNRILSFCPITDKPVPLKSAKEFMEFRCAMFLANIRVKDVIASEMRSLSKNELHIIWELIKEKGYLTASEFKRAVRSLGKFSQDNLDGLMIITESATNLIIDPVQKLIHSNQILSVLWSEIPDFIAKECLFQLGKKRSITLSEIISKMEENLSEGFVTALDKAYKKVQKKNPDKQQWLERKNYRASFDKGRAPYGRDIMKKVVLEVLGGKDPREKGGCLYITEEIREKVNHRKLDELTNNHLVRHRLLILNRLFDDMVDDFADGDKERIKTVVLEVNREISELSGKTTKEIKKEEGLKRAEHKKAREKMEAAVKDSGENIVITAGLIRKARIAQDLNWTCPFTGKEYDPIDLIHKQVDLDHIIPRAERLSDSMGGLVVTFSEVNRMKGKRTAWQFIQDEQGKPVKGKPVLSIRTMKNYETFVSKLKTFGGVKSDEARRKMRKQFLLMPDYKEKGFTPRDLTLTSYVTKLALQQIKNQFDTCRKKPQVIALPGRLTGETRKTWKLMGLLHVVNEKIDGKTLKNDIRS

SEQ ID NO: 350 - protein, 789 aa, Unknown; identical to SEQ ID NO: 349
  Description of Unknown: uncultivated organism with predicted taxonomy: Verrucomicrobia bacterium
  MG2-34 effector

SEQ ID NO: 351 - protein, 783 aa, Unknown
  Description of Unknown: uncultivated organism with predicted taxonomy: Thermogutta terrifontis
  MG2-35 effector
VVIGGSRPLLKEERFALNSIMEATGYFTKATLKKAFEKSLKLDPVNLDAMFLIPEMEQALTLDPARREVTTNKIIKPVWKTVPAIWKNIFSNQLFHGRNYQGKPPSFSQWRDRIKEKGDSIEEFDDSVASAYKVECQNLSKKGLEVSFEEFCGRPIRVSKRHMASGRAPYSRGKLTEAVHCVFNGDDPKAEGGPLEETEAVRCAQWNLEIDENTNNHLVRHRLKVFVRVLEDLVKRYADNDPRNVSSVCVEVVRDLVEFSGKSAKEKARILGQQLWHHRKISKFLEEEKAKNEGNWEISAGLIKKARIADDLNWICPYTGKQYSLNQIIHGDVDLEHIIPRSKRPTDALHALVLTFSHINREKGARTGLQYIEDTKDSPHTLTPEQYRKFVGRLKKNGPSKDDELRCTKRKIALLTQDYEPRGKAKEKSDSESVSGFTEGSLTQTSYLNKLAAQQVQRWFSDQLDEDVKLPPVVQLSGSVTAAVRRSWDLFDQLQQVCPETRGKSKSDIRGMTHLHHALDAVTVGLAAHLFPKDGHLWALMSKRKITRPSDRDYMRSRLGDLVSFNNDGKWRLEALPESLLFEVAGKLAEQRVVRHMPGTMRGLKVQQNVWRILGEDSRDESKMVIRMRPRGEDGKKTIKQKTEKKSKLLGALPKNASSKLKDLKGALIVEENYGVALDPEPVVMPYRQVWKQLVELRKQNGGQPVRVIRNGNVISVKKGRYAGKWRVHSIKDASMGLVLDMAAPDLVKAENQSHRSKMNVLLKTLLKNGLVVMQSDSALFSL

SEQ ID NO: 352 - protein, 1114 aa, Unknown
  Description of Unknown: uncultivated organism with predicted taxonomy: Coraliomargarita sp. CAG:312
  MG2-36 effector
LASYSTKKNGAIIRAAEQENSFTFEVPYERAVFKFEPLILSLIPFKINDNNLKMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSGGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 353 - protein, 817 aa, Unknown
  Description of Unknown: uncultivated organism with predicted taxonomy: Coraliomargarita sp. CAG:312
  MG2-37 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDIYGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVSVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGE

SEQ ID NO: 354 - protein, 1061 aa, Unknown
  Description of Unknown: uncultivated organism with predicted taxonomy: Coraliomargarita sp. CAG:312
  MG2-38 effector
MSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDVKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 355 - protein, 1108 aa, Unknown
  Description of Unknown: uncultivated organism with predicted taxonomy: Verrucomicrobia bacterium
  MG2-39 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPRRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDIYGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 356 - protein, 1114 aa, Unknown
  Description of Unknown: uncultivated organism with predicted taxonomy: Coraliomargarita sp. CAG:312
  MG2-40 effector
LASYSTKKNGAIIRAAEQENSFTFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMDDLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 357 - protein, 1108 aa, Unknown
  Description of Unknown: uncultivated organism with predicted taxonomy: Coraliomargarita sp. CAG:312
  MG2-41 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 358 - protein, 1108 aa, Unknown
  Description of Unknown: uncultivated organism with predicted taxonomy: Coraliomargarita sp. CAG:312
  MG2-42 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVVPEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 359 - protein, 1108 aa, Unknown; identical to SEQ ID NO: 357
  Description of Unknown: uncultivated organism with predicted taxonomy: Verrucomicrobia
  MG2-43 effector

SEQ ID NO: 360 - protein, 1114 aa, Unknown
  Description of Unknown: uncultivated organism with predicted taxonomy: Coraliomargarita sp. CAG:312
  MG2-44 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMDDLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 361 - protein, 1101 aa, Unknown
  Description of Unknown: uncultivated organism with predicted taxonomy: Coraliomargarita sp. CAG:312
  MG2-45 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWGLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKS

SEQ ID NO: 362 - protein, 1114 aa, Unknown; identical to SEQ ID NO: 356
  Description of Unknown: uncultivated organism with predicted taxonomy: Coraliomargarita sp. CAG:312
  MG2-46 effector

SEQ ID NO: 363 - protein, 1108 aa, Unknown; identical to SEQ ID NO: 357
  Description of Unknown: uncultivated organism with predicted taxonomy: Verrucomicrobia bacterium
  MG2-47 effector

SEQ ID NO: 364 - protein, 1114 aa, Unknown
  Description of Unknown: uncultivated organism with predicted taxonomy: Coraliomargarita sp. CAG:312
  MG2-48 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPEISPNGSILRKARIADDLGWVCPYTGCHFSPRQLFESGNMEREHIIPRSLRPSDSLESLVITWKEVNDMKGQCTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 365 - protein, 1108 aa, Unknown; identical to SEQ ID NO: 357
  Description of Unknown: uncultivated organism with predicted taxonomy: Coraliomargarita sp. CAG:312
  MG2-49 effector

SEQ ID NO: 366 - protein, 1114 aa, Unknown
  Description of Unknown: uncultivated organism with predicted taxonomy: Coraliomargarita sp. CAG:312
  MG2-50 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKIGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVCEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 367 - protein, 888 aa, Unknown
  Description of Unknown: uncultivated organism with predicted taxonomy: Coraliomargarita sp. CAG:312
  MG2-51 effector
VDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTAYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIAREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 368 - protein, 1108 aa, Unknown
  Description of Unknown: uncultivated organism with predicted taxonomy: Verrucomicrobia bacterium
  MG2-52 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLVVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 369 - protein, 1108 aa, Unknown
  Description of Unknown: uncultivated organism with predicted taxonomy: Verrucomicrobia bacterium
  MG2-53 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDIYGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 370 - protein, 865 aa, Unknown
  Description of Unknown: uncultivated organism with predicted taxonomy: Coraliomargarita sp. CAG:312
  MG2-54 effector
MSINILNNLRESNKFELSFDIGYSSIGWSVFKKQSGGIFPTLLGAGTVIFDDDACLAKSRAGFRRMRKNIASRRNRIKRLRDAMLNLDVMAVDELDNAKTAYPWFLSAKVLACGKKLSWSELWSVIRYYAHNRGYDGNSAWAEIESDSDGDFEKEANAKKLMAELGTSTQAETVCAYLGVDVKSDKPLSLRKYFKGQNLAFPRETVVKEVERIIDAHIGVLPKCDGNFKKLMIGNWREVPSNIELPRRFTSDRGLLFGQYIPRFDNRIITKCPISGEKTPNCHSREFLDFRWKSLLANMAFPDGADLIAARAKVDAAMFLYGALKKTVLKKILKEVLGELPSNYNAMFLASEMEKALELDPVKALILKTAYPNISFSLPSAELVEKLWKLIPKFVFTRMFKLKEYSFADICALLDSEKSEELKNVVRAIFDSSASSKKSPKPDFETAFNYKMRVKKISGRSPYSRRLMKLASEEIMRGIDPRSEGGSLYPRRDSTRKELLSNIDSWTNNHLVRHRLKMFKRLYMDIVNEYCGGDISLVKSVAIEVVKDMTAFSGLDSKKKAAKLKDLVAHHESVSKYLKNEYPNLKTNGSILRKARIADDLGWVCPYTGCHFSPRQLFESGNMEKEHIIPRSLRPSDSLESLVVTWKEVNDMKGQRTALEFIKECQGMKVPGRPNLSIVTPARFEEFVSGLRKPMHRAGKADIERIKIRNKLLLTEHYKNREGEFLPSDLTQTSHLNKLAFKLVKSLYVDAGKTPELVHLPGSVTSAVRKNWELLPCMGDVCPEIYETLENGDKVLLLKDKIRSITHLHHAVDAVAMGLAASVFPRTKRFYEAVSKRHLSEADREELLNTGLVLFSDDKWKLVEL

SEQ ID NO: 371 - protein, 1061 aa, Unknown
  Description of Unknown: uncultivated organism with predicted taxonomy: Coraliomargarita sp. CAG:312
  MG2-55 effector
MSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVDRIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 372 - protein, 1114 aa, Unknown
  Description of Unknown: uncultivated organism with predicted taxonomy: Coraliomargarita sp. CAG:312
  MG2-56 effector
LASYSTKKNGAIIRAAEQENSFIFEVPYERAVFKFEPLILSLIPFKINDNNLKMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPRRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWNLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 373 - protein, 1108 aa, Unknown
  Description of Unknown: uncultivated organism with predicted taxonomy: Coraliomargarita sp. CAG:312
  MG2-57 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTSKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 374 - protein, 1108 aa, Unknown; identical to SEQ ID NO: 357
  Description of Unknown: uncultivated organism with predicted taxonomy: Verrucomicrobia bacterium
  MG2-58 effector

SEQ ID NO: 375 - protein, 1061 aa, Unknown; identical to SEQ ID NO: 354
  Description of Unknown: uncultivated organism with predicted taxonomy: Coraliomargarita sp. CAG:312
  MG2-59 effector

SEQ ID NO: 376 - protein, 1114 aa, Unknown; identical to SEQ ID NO: 366
  Description of Unknown: uncultivated organism with predicted taxonomy: Coraliomargarita sp. CAG:312
  MG2-60 effector

SEQ ID NO: 377 - protein, 1114 aa, Unknown
  Description of Unknown: uncultivated organism with predicted taxonomy: Coraliomargarita sp. CAG:312
  MG2-61 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 378 - protein, 1101 aa, Unknown
  Description of Unknown: uncultivated organism with predicted taxonomy: Verrucomicrobia
  MG2-62 effector
MDPANLALSFDIGYASLGWAVFLLKDPFPSLLGSGSVLFQKDSCLASSRRAFRRARRNIAARRSRVARLKKYLASLGVLEREQLDENACAYPWLLAARVLASDGKEKLSWQELWHVLRWYAHSRGYDGNALWAGDALDETGADDEDTQKVKAARALMEKYGKTTMAETVCADLQLEPFGEKRASRRYFKGNNAAFPRETVRDEVRRILLAHAGVLPKVDDALAATLLNDVPENLCAALRLPARFSAKGGLLFGQYVPRFDNRIIGHCRITGKNVPLKNCREYLLYRWGRLLNNLTVFARDGSIRTLSADKPNGRPSEREKLDAEMRSRGFFDKKKLNDLLKEITGCEPANTESYFLIPEMEDALILDPVRKLIATKKLVKDFWGYFSERGKKIFAAELAKGKTLKLSDCIKRMDGWGGWKTKPLFAAALEKLKAAEMKKKPEKRRNLLNLRIKAEFPTGRASYCREILKKTYEEALAGKDSTQPGGCLYETPEIRERLLRGNAVGDDAGTVATEQWLAGQTNNHMVRHRMLIFSRLLRDIIREYAEGDAARVKDVVVEVVRELKEFSGLSAQEIATKLNEKFANFNSVAEKIEAAAQEKGVSVSASLIRKARLLEDQGFACPYTGKNISYNELFSGALEIEHIIPRSLRPSDALSSCVMTFRAVNDMKGQRTAMQFMKECAGKDVPGTNLQIQPLANFKEWVEAHRSQKLRRGFSKEDQARCKRRAELLLVERYEERNADFTERDLTQTSHLNKLAIRLVKRELGIDARHLAGAVTGFVRKNLSIDECLVAAVPRMQRAQRVSEHDSRKLLKSQMRELSHLHHAMDAITQGLTGILFRVEDWKLLVKRHLTERERAVLAAKYPTLLRFSANGEIALKPLPDSLLSEITARLKECRVVQHVPAKMHGLAVEQTTWSIVSQDEATRKVSLEQHTTDLKKGRYKDDGTRFVKNCEEKPALLLGFGVPEEQKSKLQAIKGVVKICENWGCALDPEPVVIPYFKVFPRLRELRERNGGKPVRVLRRGQQIEVLSGKFKGVWTIVSIKDATRDGILLDICAPDKVRQTEHGTTDSKVGVLLKSLLRAGLKILKPPLTGFACPTTSSQ

SEQ ID NO: 379 - protein, 1114 aa, Unknown
  Description of Unknown: uncultivated organism with predicted taxonomy: Coraliomargarita sp. CAG:312
  MG2-63 effector
LASYSTKKNGATIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 380 - protein, 888 aa, Unknown; identical to SEQ ID NO: 367
  Description of Unknown: uncultivated organism with predicted taxonomy: Coraliomargarita sp. CAG:312
  MG2-64 effector

SEQ ID NO: 381 - protein, 1108 aa, Unknown; identical to SEQ ID NO: 369
  Description of Unknown: uncultivated organism with predicted taxonomy: Coraliomargarita sp. CAG:312
  MG2-65 effector

SEQ ID NO: 382 - protein, 1046 aa, Unknown
  Description of Unknown: uncultivated organism with predicted taxonomy: Coraliomargarita sp. CAG:312
  MG2-66 effector
LPSYSTKKNGAIIRAAEQENSFIFEVPYERAVFKFEPLILSLIPFKINDNNLRMSTTNLNNFNLSFDIGYSSIGWSISSKPANAVFPNWLGAGVVVFDDDSCMAKSRAEFRRMRRNIASKRNRIKRMREVLYGLGVMGKDELDNAKTEHPWFLAAETLASGKILSWSELWSVLRYYAHNRGYDGNSMWAKFGDDSDGDFEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILR

SEQ ID NO: 383 - protein, 1114 aa, Unknown; identical to SEQ ID NO: 352
  Description of Unknown: uncultivated organism with predicted taxonomy: Coraliomargarita sp. CAG:312
  MG2-67 effector

SEQ ID NO: 384 - protein, 1114 aa, Unknown; identical to SEQ ID NO: 364
  Description of Unknown: uncultivated organism with predicted taxonomy: Coraliomargarita sp. CAG:312
  MG2-68 effector

SEQ ID NO: 385 - protein, 1114 aa, Unknown; identical to SEQ ID NO: 356
  Description of Unknown: uncultivated organism with predicted taxonomy: Coraliomargarita sp. CAG:312
  MG2-69 effector

SEQ ID NO: 386 - protein, 1114 aa, Unknown; identical to SEQ ID NO: 360
  Description of Unknown: uncultivated organism with predicted taxonomy: Coraliomargarita sp. CAG:312
  MG2-70 effector

SEQ ID NO: 387 - protein, 1114 aa, Unknown; identical to SEQ ID NO: 356
  Description of Unknown: uncultivated organism with predicted taxonomy: Coraliomargarita sp. CAG:312
  MG2-71 effector

SEQ ID NO: 388 - protein, 1114 aa, Unknown
  Description of Unknown: uncultivated organism with predicted taxonomy: Coraliomargarita sp. CAG:312
  MG2-72 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDMWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 389 - protein, 1108 aa, Unknown; identical to SEQ ID NO: 368
  Description of Unknown: uncultivated organism with predicted taxonomy: Verrucomicrobia bacterium
  MG2-73 effector

SEQ ID NO: 390 - protein, 1101 aa, Unknown
  Description of Unknown: uncultivated organism with predicted taxonomy: Verrucomicrobia
  MG2-74 effector
MDPANLALSFDIGYASLGWAVFLLKDPFPSLLGSGSVLFQKDSCLASSRRAFRRARRNIAARRSRVARLKKYLASLGVLEREQLDENACAYPWLLAARVLASDGKEKLSWQELWHVLRWYAHSRGYDGNALWAGDALDETGADDEDTQKVKAARALMEKYGKTTMAETVCADLQLEPFGEKRASRRYLKGNNAAFPRETVRDEVRRILLAHAGVLPKVDDALAATLLNDVPENLCAALRLPARFSAKGGLLFGQYVPRFDNRIIGHCRITGKNVPLKNCREYLLYRWGRLLNNLTVFARDGSIRTLSADKPNGRPSEREKLDAEMRSRGFFDKKKLNDLLKEITGCEPANTESYFLIPEMEDALILDPVRKLIATKKLVKDFWGYFSERGKKIFAAELAKGKTLKLSDCIKRMDGWGGWKTKPLFAAALEKLKAAEMKKKPEKRRNLLNLRIKAEFPTGRASYCREILKKTYEEALAGKDSTQPGGCLYETPEIRERLLRGNAVGDDAGTVATEQWLAGQTNNHMVRHRMLIFSRLLRDIIREYAEGDAARVKDVVVEVVRELKEFSGLSAQEIATKLNEKFANFNSVAEKIEAAAQEKGVSVSASLIRKARLLEDQGFACPYTGKNISYNELFSGALEIEHIIPRSLRPSDALSSCVMTFRAVNDMKGQRTAMQFMKECAGKDVPGTNLQIQPLANFKEWVEAHRSQKLRRGFSKEDQARCKRRAELLLVERYEERNADFTERDLTQTSHLNKLAIRLVKRELGIDARHLAGAVTGFVRKNLSIDECLVAAVPRMQRAQRVSEHDSRKLLKSQMRELSHLHHAMDAITQGLTGILFRVEDWKLLVKRHLTERERAVLAAKYPTLLRFSANGEIALKPLPDSLLSEITARLKECRVVQHVPAKMHGLAVEQTTWSIVSQDEATRKVSLEQHTTDLKKGRYKDDGTRFVKNCEEKPALLLGFGVPEEQKSKLQAIKGVVKICENWGCALDPEPVVIPYFKVFPRLRELRERNGGKPVRVLRRGQQIEVLSGKFKGVWTIVSIKDATRDGILLDICAPDKVRQTEHGTTDSKVGVLLKSLLRAGLKILKPPLTGFACPTTSSQ

SEQ ID NO: 391 - protein, 1089 aa, Unknown
  Description of Unknown: uncultivated organism with predicted taxonomy: Coraliomargarita sp. CAG:312
  MG2-75 effector
VPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 392 - protein, 876 aa, Unknown
  Description of Unknown: uncultivated organism with predicted taxonomy: Verrucomicrobia bacterium
  MG2-76 effector
MSAKQNPPPDLSLSFDVGHSSIGWAVLQTSPDVEIKGCGVVIFRADDCLASARRGYRRQRRHIRSTRQRIKRMKALLLHLCVLTQAQLDKPGCAWQWKLAGRVLAGGKTLTWTELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFVKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPDR

SEQ ID NO: 393 - protein, 1090 aa, Unknown
  Description of Unknown: uncultivated organism
  MG2-77 effector
MSAKQNPPPDLSLSFDVGHSSIGWAVLQTSPDVEIKGCGVVIFRADDCLASARRGYRRQRRHIRSTRQRIKRMKALLLHLCVLTQAQLDKPGCAWPWKLAGRVLAGGKTLTWHELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 394 - protein, 1090 aa, Unknown
  Description of Unknown: uncultivated organism with predicted taxonomy: Verrucomicrobia bacterium
  MG2-78 effector
MSAKQNPPPDLSLSFDVGHSSIGWAVLQTSPDVEIKGCGVVIFRADDCLASARRGYRRQRRHIRSTRQRIKRMKALLLHLCVLTQAQLDKPGCAWPWKLAGRVLAGGKTLTWPELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 395 - protein, 1087 aa, Unknown
  Description of Unknown: uncultivated organism with predicted taxonomy: Verrucomicrobia bacterium
  MG2-79 effector
MNATQKIQPATNSDLQLAFDVGHSSLGWAVLQSSAGIPPAAKRTAGDNSINILSCGAVVFRADDCLASSRRTYRRQRRHIRSTKQRIARMKIILRHLGVLKENELNQPGCAWPWQLAARILQGGKLLTWPELWDVLRWYAHNRGYDGNRRWSAAEAEAQKEDSEKEANARTLMGKHGVHSMAETFCKELGVDPLGKKKSSMKRFKGLNAAFPREVVEGEVRKVLQAHSGKLKGVDVNLEKNLFSDWRAIPCPDLKLPKRYEDGLLFGQLVPRFDNRIISICPISGQKVPSRNCPEFLNFRWAMQLANIKVGKTKDRELQPLKTEYRVALDKQMRERGYLTPKELKDTVRSITSCERDNLDTMLMHPDAKEALLLDPVQKLICSNDLQPLWKLLPERLQKRLRGQWRHNKVFTLAQIRKQLESLGDVSAFDAEFQKQLDTQNSKAKKKEKQVTREQLLQQHFPSRPLKLDGRAAFARHLLKQAYEDVLAGKPHPKEEGGCLFITKKIREAQLNRAIADQTNNHLVRHRLLILERLLADIIKEYAAGDKKRVGKITIEVNRDLREMSGKTAKEKAQDLGLRIANHHAVAEKLEKAFAEERNGKSIPITAGLIRKARIAEDLGWRCPYTGIDYEPKDLVTKRVDKDHIVPRSERASDSLDSLVITLSAINKWKGKRTAWQFVEQEQGKPVPDLPNLSIVSLTRYKQFVESLETYKGHDDDKRRKKKRKELMLLPKYEEREFVPRDLTQTSQLVRLGGQVLKRAFANSEEKPTLVSLPGSVTGAVRKAWKVLGCLSLANQQVLDENGDVKTKTDIRDITHLHHALDACVLGLTSHFIPNNGRVWELIVKRNPNDLERQQLMALGVFGFNAEKRFEMRDLDNKLKEQIRQRLAEKRVVQHIPARMDGLRVEQNTWRVVSSDENGNVTIRQRIRQADGSRPEKLGEEKTTKLLGLKPANGNGKLAANKGVLVIPDNYGVALDPLPTIIPFHKVWPRLQELKKANGGKLPRVLRNGQTIKVPEGKYKGVWRIFSAKNNATGMAIDIGQPDVVRLKNKTEGHKINVLLTSLLKNKMEVVKTPFTGISAIPATSST

SEQ ID NO: 396 - protein, 974 aa, Unknown
  Description of Unknown: uncultivated organism with predicted taxonomy: Verrucomicrobia bacterium
  MG2-80 effector
DVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDINEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 397 - protein, 851 aa, Unknown
  Description of Unknown: uncultivated organism with predicted taxonomy: Verrucomicrobia bacterium
  MG2-81 effector
MSPKLEFSFDVGHSSIGWAVLQSSAVVSPVANAPRVNILGCGVVTFGADDCLASKRRDYRRQRRHARSTRHRIAQLEKLLAHLKVLSADQLKQKHQQAGGHAAPWFLAARVLASNGAAKYLLDWPQLWDVLRWYAHNRGYDGNRRWSAQEAEAQSEDTEKEKTANALMEKHGTTTMAETLCKALGLEPLGDKQSSKENFKRLNAAFPRSIVEKEVRRLLELHQKKLPAITDTFLKSLFEDWRAAKISDLKLPDRYQGGLLFGQLVPRFDNRIISTCPITGEKVPSKNCPEFLKFRWAMTLANIRVAGAKEKELRPLAADERKKINVVMESEGALTPRELTKLVRETTGCTRDNLDTMLMHPDAKDGLLLNPIQKLVQGDKLKTLWPTFSPRVQKRARDLWERGKPVTLEHICGIAKKLGESLANFEAKLNKLADSANTKRSKKAGSLDSEALLKEPLTIKKSDGRAAYARPLLVRAYAEVMAGKHPKEDGNSLCVTEEMRQAQLQKQIDQQTNNHLVRHRLLILERLLKDLIADSAFANGDKSRIARTTIEVNRDLREMSGKSAKEIQQDLGRRLANHHGVAAKLDADLDGRTFNGKPIQITAGLIRKARIAEDLGWTCPYTGKTYDAIDLVSRQVDKDHIIPRSLRPSDSLDSLVVTFAEVNKMKGQRTAWKFVSDEQGKVVEGSPQLSIVSLTRFKQWAESLETYKGHDDDKRRKKKRKELLLLPNYEEKGFVPRDLTVTSQLVRLGAQIIKKTFAGSEKPPMVVSLPGSVTGTVRKGWNLLGCLELAAPQVKEADGGIKNKTDIRDVTHLHHALDACVLGLASYYLPNNGGLWEVMIKRNPNDGEKAL

SEQ ID NO: 398 - protein, 1082 aa, Unknown
  Description of Unknown: uncultivated organism with predicted taxonomy: Verrucomicrobia bacterium
  MG2-82 effector
PDLSLSFDVGLSSIGWAVLQTSPDVEIKGCGVVIFRADDCLASARRGYRRQRRHIRSTRQRIKRMKALLLHLCVLTQAQLDKPGCAWPWKLAGRVLAGGKTLTWPELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLKDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 399 - protein, 1075 aa, Unknown
  Description of Unknown: uncultivated organism
  MG2-83 effector
MSIKGKISNGADANLQISFDVGHSSIGWAVLEKTGQQVSDIKINGCGSVVFRADDCLASSRRAYRRQRRHIRSTRQRIARMKILLKHLGVLTEKELDKPGCAWPWKLAAQILQGGKLLTWPELWDVLRWYAHNRGYDGNRRWSAAENDAQSEDSEKEENARSLMGKYGTKSMAETFCAISGINPLGEKKSANLSGDKRPKGQNAAFPREIVELEVRQILQKHFGKLKNADENLEKVLFTDWQTISCPDLKLPKRYEGGLLFGQLVPRFDNRIISTCPISGQKVPTRNCTEFLNFRWAMQLANIRIACAGEKELRPLTAAERKIIDQAVSEKGGVTPFQLKLIVREKTKCVRDDLEQMLMLPDFEKALLLNPIQKMISADDFQPYWKLLPDRLQKRLRGKWRRGKVFSLAQIRTQLESLGDASAFDAELQRQLDAHNSNAKKKDKQITRENLLQKHFPSKPLKLDGRAAFARHLLKQAYDEVLAGKDPNGKGGCLFRSEEIRQKELNREISDQTNNHLVRHRLLILERVLNDIIKEYAGGKKDRIGKITIEVNRDLREMSGKTAKEKAQDLGLRIANHHNVAEKLEKAFAEEGIKQTITAGLIRKARIAEDLGWHCPYTGIQYEPKDLITRRVDKDHIVPRSERASDSLDSLVVTFSAINKWKNKRTAWQFVTDEQGKTVPDLPNLSIMSLARYKQFVESLESYKGHDDDKRRKKKRKELMLLPKYEEKEFMPRDLTQTSQLVRLGAQVLKKNLPHLTTGDVTSLPGSVTGTVRKGWKLEACLGLANPQVFDGNGGAKTKTEIRDITHLHHALDACVLGIAANYFQNQKLGASSLWELLIKRKYNEQEKTILRALGIFQFDKEGNSQIKELPKEIREQIRQRLAEKRVVQHIPARMDGLRVEQNTWRVVAVKDGEVILKQRIRQPDGTRPEKIAEEKPGKLLGLNPTNGNGKLAANKGALVIPDNFGVALDPQPIVIPFHKVWTRLQELKKANAGKLPRVLRNGQLIRVKDGTYKGVWRVFSAKNNATGMALDIGSPDVVRLKNKTEGHKINVLLSSLIKGGLEPIQSSFTGITSK

SEQ ID NO: 400 - protein, 938 aa, Unknown
  Description of Unknown: uncultivated organism with predicted taxonomy: Verrucomicrobia bacterium
  MG2-84 effector
VYHNGDMASRRNAPDLQLAFDVGHSSIGWAVLQANPDVEIAGCGVVIFRADDCLASARRGYRRQRRHIRSTRQRIKRMKALLLHLGVLTQTQLDKSGCAWPWKLAARVLVGGKTLTWPELWDVLRWYAHNRGYDANRRWSAAEAEAEKEDTEKLENAKTLMDKHGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRL

SEQ ID NO: 401 - protein, 1090 aa, Unknown
  Description of Unknown: uncultivated organism with predicted taxonomy: Verrucomicrobia bacterium
  MG2-85 effector
MSAKQNPPPDLSLSFDVGHSSIGWAVLQTSPDVEIKGCGVVIFRADDCLASARRVYRRQRRHIRSTRQRIKRMKALLLHLCVLTQAQLDKPGCAWPWKLAGRVLAGGKTLTWPELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 402 - protein, 985 aa, Unknown; identical to SEQ ID NO: 326
  Description of Unknown: uncultivated organism
  MG2-86 effector

SEQ ID NO: 403 - protein, 909 aa, Unknown
  Description of Unknown: uncultivated organism with predicted taxonomy: Methylococcales bacterium
  MG2-87 effector
LENAKTLMDKPGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRLSGALVVGENFGVALDPQPTIIPFHKVWPRLQELKKANGGKLPRVLRNGQIIYIPKGTYSGVWKVFSAKNNKSGMALDMGRPDVVRLRNKTDGHKINVLLSSLLKDGMTIVDAPLTGVSSAPKQS

SEQ ID NO: 404 - protein, 985 aa, Unknown; identical to SEQ ID NO: 326
  Description of Unknown: uncultivated organism
  MG2-88 effector

SEQ ID NO: 405 - protein, 985 aa, Unknown; identical to SEQ ID NO: 326
  Description of Unknown: uncultivated organism with predicted taxonomy: Verrucomicrobia
  MG2-89 effector

SEQ ID NO: 406 - protein, 807 aa, Unknown
  Description of Unknown: uncultivated organism with predicted taxonomy: Verrucomicrobia bacterium
  MG2-90 effector
MSIKGKISNGADANLQISFDVGHSSIGWAVLEKTGQQVSDIKINGCGSVVFRADDCLASSRRAYRRQRRHIRSTRQRIARMKILLKHLGVLTEKELDKPGCAWPWKLAAQILQGGKLLTWPELWDVLRWYAHNRGYDGNRRWSAAENDAQSEDSEKEENARSLMGKYGTKSMAETFCAISGINPLGEKKSANLSGDKRPKGQNAAFPREIVELEVRQILQKHFGKLKNADENLEKVLFTDWQTISCPDLKLPKRYEGGLLFGQLVPRFDNRIISTCPISGQKVPTRNCTEFLNFRWAMQLANIRIACAGEKELRPLTAAERKIIDQAVSEKGGVTPFQLKLIVREKTKCVRDDLEQMLMLPDFEKALLLNPIQKMISADDFQPYWKLLPDRLQKRLRGKWRRGKVFSLAQIRTQLESLGDASAFDAELQRQLDAHNSNAKKKDKQITRENLLQKHFPSKPLKLDGRAAFARHLLKQAYDEVLAGKDPNGKGGCLFRSEEIRQKELNREISDQTNNHLVRHRLLILERVLNDIIKEYAGGKKDRIGKITIEVNRDLREMSGKTAKEKAQDLGLRIANHHNVAEKLEKAFAEEGIKQTITAGLIRKARIAEDLGWHCPYTGIQYEPKDLITRRVDKDHIVPRSERASDSLDSLVVTFSAINKWKNKRTAWQFVTDEQGKTVPDLPNLSIMSLARYKQFVESLESYKGHDDDKRRKKKRKELMLLPKYEEKEFMPRDLTQTSQLVRLGAQVLKKNLPHLTTGDVTSLPGSVTGTVRKGWKLEACLGLANPQVFDGNGGAKTKTEIRDITH

SEQ ID NO: 407 - protein, 1075 aa, Unknown; identical to SEQ ID NO: 399
  Description of Unknown: uncultivated organism
  MG2-91 effector

SEQ ID NO: 408 - protein, 774 aa, Unknown
  Description of Unknown: uncultivated organism with predicted taxonomy: Verrucomicrobiae bacterium Tous-C5FEB
  MG2-92 effector
ELWDVLRWYAHNRGYDGNQRWSNREMIRAFNSEGLHQTSKPSADDEKSLVAAAEKADAEAGVQNEADSDVKKVKEAFKQMHDYGTSTMAETMASHIAKFEIQAAEHRLGKRQEKPTRFKGLGAAFPRRIIRVINNEQTLAGGVEWEVRYILRAHFGHLPNCDANFERAICGGLPESKFDWRAYEQSHPTLYLTSKAEKLKLRELRIPRKADKQTKADKKKLRTEFLRNKLVLSSHFEGGVLFGQAVPRFDNRIISICPITGEKVPSKNCREFLKFRWAMMLANIHVAGAKEKELHPLTGDERKKINAVMENEGALTPTTLKRSVRETTNCTRDNLEMMLMHPDAKDALLLNPIQKLVRSEKLKTIWPTFSYPVQKRARDLWLRGKLVTLERICGIAQKLGESLTGFEAELNKLADVANTKRGKKESSFNREALMREPLTIIKLDGRAAYARPLLVRANAEVMAGKHPKEEGGCLEVTDAMRQVQLQKQIDQQTNNHLVRHRLLILERLVKDLVAEPAFASGDKSRIAKCTIEVNRDLREMSGKSSKEIQQDLGRRLANHHGVAAKLEKDLDGRTFNGKPIQITAGLIRKARIAEDLSWMCPYTSKAFDAIDLVSRQVDKDHIIPRSLRPSDSLDSLVVTFAEVNKMKGQRTALQFVSDEQGKTVEGSPQLSIVSLTRFKQWAESLETYKGHDDDKRRKKKRKELLLLQTYEEKGFVPRDLTVTSQLVRLGAQIIKKTFAENEKLPTVVSLPGSVTGTVRKGWNLLGCLATAAPQ

SEQ ID NO: 409 - protein, 1081 aa, Unknown
  Description of Unknown: uncultivated organism
  MG2-94 effector
MKQDQIAFSFDVGHSSIGWAVFKIADTPESFHTLLGTGVVLFPKDSCLASSRRGFRRSRRNIAARRSRIDRLKNYLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGTDGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAHLQKKAKKKDADLVAHYFKANYPTGRAAYCREILAKTFAESMAGKDSTKEGGCLYETEEIRNRLLREPLVKQTNNHLVRHRLLIFERLLDQMVAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAYEAYVAKHKKQYRYGTDDRRRCERRAELMLMERYDQRNADFTERDLTQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSERRLLKSRYPYLVFTENSRMDIQDLPDATLKTISGRLAECRVVRHIPAKMHGIVVDQTTWGIVASGAITKLCQKTTEKNARYDENGRRFVKTAEEKRSLLLGGPNAPEGKLARIKGAILITENWGCALDPAPPTVIPHFKVYPQLRALREKNGGRPVRILRKGSLIQIKTGRFQGIWSVASIKDNADGICLDINAADKIKIENGSVDSKINVRLNSLLNSGLKILKPKLTGTCPTTSSP

SEQ ID NO: 410 - protein, 1081 aa, Unknown; identical to SEQ ID NO: 409
  Description of Unknown: uncultivated organism
  MG2-95 effector

SEQ ID NO: 411 - protein, 1080 aa, Unknown
  Description of Unknown: uncultivated organism
  MG2-96 effector
MKQGQIAFSFDIGHSSIGWAAFQVSDAPGTFHSLLGTGVVLFPKDACLASARRGFRRSRRNIAARRSRIDRLKNYLAGLGVLSRDQLDANSNSYPWLLAARILASDGKKTLTWEELWSVLRWYAHNRGYDGNALWAGDDADAGDKEDTDKVKNSIALMEKHKTATMAETVCKALGLDPMGEVKASRIYFKGNNAAFPRGVVTEEVRRILAAHAGKLPKVDDALSDILLRNAATSGLELPARFKGGLLFGQYVPRFDNRIIPACRITGKNTPLKRCPEYLLYRWGRLLNNLTVFGADGQIRTLLPAERQALHSRMEADGFFTKRTLNAALKDVTGCTPANTESFFLTEEMEEALVLDPVKKLLATNQIMKDLWPQLSAESREKAQSSLSAGKKIRLGDILAEMETAGQDTTAASDALASHQKKAKKKNADLATRRLSADYPKGRAAYCREILAKTFDESISGKDSTKEGGCLYETEEIRNRLLREPLVQQTNNHLVRHRLLVFERLLAHMVEEFAGGDEKRIAATVVEVVRELQEFSGLNSKEITHKLNEKLGNFRSVVKNLEEAIANSEERVAITGSLIRKARILEDQGFVCPYTGTHLSYNHLLADRLEIEHIIPRSLRPSDALSSCVMTFRSVNDMKGQRTAMQFICEEQGREVPGHENIQITTKKAYVDYVAKHKKQYPQKSDDRRRCERRAELMLMERYDQRNADFTERDLTQTSHLNKMAIRLVKQRIGIDAKHLPGNVTAFIRQKLHIDECLFNAVPRLQTAAKGQPKSSKRKKKAEEAPVEPIQDDMPPRKLTKADIRELTYLHHAMDAVTQGLALLLFAPEDWPLLVKRNLPDSEQRHLKARYPFLDFSADKHISIQDLPEDTLHTISERLAECRVVRHIPAKMHGIIVDQTTWGIVAAGAITTLRQKTTEKNARCDENGKRFIKTTEKKRSLLLGGPDAPDGKLAKIKGAILVTENWGCALDPSPTVIPHFKVYPQLRALREKNGGRPIRILRKGSLIQVKAGTYQGIWSVASIKDNADGICLDINAADKVKLENRSDDSKINVRLDSLRKSGLKILKPKLTGACPTTSSP

SEQ ID NO: 412 - protein, 953 aa, Unknown
  Description of Unknown: uncultivated organism with predicted taxonomy: Acidobacteria bacterium RIFCSPLOWO2_12_FULL_68_19
  MG2-97 effector
MKQDQIAFSFDVGHSSIGWAVFKIADTPESFHTLLGTGVVLFPKDSCLASSRRGFRRSRRNIAARRSRIDRLNNFLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGADGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAQLQKKAKKKDADLVAHYFKANYPTGRAAYCREILAKTFAESMAGKDSTKEGGCLYETEEIRNRLLREPLVKQTNNHLVRHRLLIFERLLDQMVAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAFEAYVAKHTKQYRYGTDDRRRCERRAELMLMERYDQRNADFTERDLTQTSHLNKMAISLVKQRIGIDAKHLPGSVTAFIRQKLHIDECLFTAVPRLQKTAKGEGKRPKRKNADEVTAEPMQSDMPPRKLTKADIRELTHLHHAMDAVTQGLALLLFAPEDWPLLVKRNLTDSERRLLKSRYPYLVFTENSRMEIQDLPEATLKTISDRLAECRVIRHIPAKMHGIVVDQTTWGIVAAGTITKLRQKTTEKNARCDENGHRFVKTIEEKRSLLLGGPNAPDGKLA

SEQ ID NO: 413 - protein, 1101 aa, Unknown
  Description of Unknown: uncultivated organism with predicted taxonomy: Verrucomicrobia bacterium
  MG2-98 effector
MTRREKSATAKFITFSFDVGHSSIGWAVLGSGQKRPSIQDAQILGCGVVTFPVDDCLANQRRDFRRQRRHIRSTRLRIERMKRLLLHLGVMTREQLDKPGCAWPWLLAAQAFHGLRTLTWPELWDVLRWFAHNRGYDGNRAWSRFEEEEPEDTERVGQGRALLIEHKTQSMAEVFCHVLGINSRDPAAQKSSRKRIREVLQAAFPRETVKAEVSAILKNHEGKLPKCDDKLATALLTDRKAIDCPTVKFPLRYIWGYLFGQLAPRFENRILTRCPFTDEKVPAKDCPEFYRFRWAMQLANVVVDEDGNSRPLTQTERQAVNARMAECGALTKSEFKKAVADATGGRPNNLETMLMHPDAEKSLVLMPARKTALSGKNKDVFNLLPSALQARLLGKLIRRGSVRLRDIRSWTENDPALLAKFDAVISSWKTKAAGREKTKLDEDETQDPLDRTWKAHPESGRAPFARPILQQAYDDVMAGKDPRMEGGILYRSEEVLRRERDRTLAEQTNNHLIRHRLLILQRLAKDLLKDYAGGKASRIVKAIIEVNSDLRTMSGMTAKERETEMKKRLSNFTSAKIALEKALTGKKIGGKPIPITAGLIRKARLAMDLDMTCPYTGQIYDFIDIAKGRMQRDHVIPYAERASDSLAAQVLTFAEVNKWKDKRTAAQFVREEQGKAVKGKPNLVVLPFEKYKAFVEGLDKGKHPHPDDKARKEKRKKLLLLEEYAEKEFLPADLTITSQLVRLGARTLEKAFTDGNHAPKIVSMPGSVTGRVQRAWSLMGCIAKANPSVLDENGKPKPKGDIRDISHLHHAVDACVLGIAGTLFPNDGSLWKAMAARSPARAEAEQLLATGLYERDSEKHLRLRDLPAALKNQIADRLSERRVYQHVSADMAGLKADQAVWRVVDFKDNHPSAQKLVRAIRIAKLDKDMAEDMAFLAHWKRKGKGVERPKNLLKETESYFVEYDIVPKAKLMGLQPGKLQELKAVKVISENYGLALDPKPEIIPFAQVWRRLAELRAENDGKPVRVLRKGSLFRVGQGKFAGEFKVFSIKKNHNGLSLDIGPRDIPRPLNKMTAQGHYINVLLSSLLKGGLEIMDTDYAMN

SEQ ID NO: 414 - protein, 1080 aa, Unknown; identical to SEQ ID NO: 411
  Description of Unknown: uncultivated organism
  MG2-99 effector

SEQ ID NO: 415 - protein, 1038 aa, Unknown
  Description of Unknown: uncultivated organism with predicted taxonomy: Proteobacteria
  MG2-100 effector
MKQDQIAFSFDVGHSSIGWAVFKIADTPESFHTLLGTGVVLFPKDSCLASSRRGFRRSRRNIAARRSRIDRLKNYLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGTDGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAHLQKKAKKKDADLVAHYFKANYPTGRAAYCREILAKTFAESMAGKDSTKEGGCLYETEEIRNRLLREPLVKQTNNHLVRHRLLIFERLLDQMVAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFICDCEKHGRDVPGHGNLQITTKKAYEAYVAKHKKQYRYGTDDRRRCERRAELMLMERYDQRNADFTERDLTQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSERRLLKSRYPYLVFTENSRMDIQDLPDATLKTISGRLAECRVVRHIPAKMHGIVVDQTTWGIVASGAITKLCQKTTEKNARYDENGRRFVKTAEEKRSLLLGGPNAPEGKLARIKGAILITENWGCALDPAPPTVIPHFKVYPQLRALREKNGGRPVRILRKGSLIQIKTGRFQGIWSVAYIKDNADGICLDIN

SEQ ID NO: 416 - protein, 916 aa, Unknown
  Description of Unknown: uncultivated organism with predicted taxonomy: Bradyrhizobium
  MG2-101 effector
MKQDQIAFSFDVGHSSIGWAVFKIADTPESFHTLLGTGVVLFPKDSCLASSRRGFRRSRRNIAARRSRIDRLKNYLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGTDGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAHLQKKAKKKDADLVAHYFKANYPTGRAAYCREILAKTFAESMAGKDSTKEGGCLYETEEIRNRLLREPLVKQTNNHLVRHRLLIFERLLDQMMAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAYEAYVAKHKKQYRYGTDDRRRCERRAELMLMERYDQRNADFTERDLTQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSEKRLLKARYPFLLFNGDNNISIQDLPEAALQTISDRLAECRVVRHIPAKMHGIDLKQTTWGVVTSGAIKKLRQK

SEQ ID NO: 417 - protein, 1088 aa, Unknown
  Description of Unknown: uncultivated organism with predicted taxonomy: Methylococcales bacterium
  MG2-102 effector
MNEKQKISPVTVPDLQLAFDVGHSSIGWAVLQNNTGISPATAKPGNDNRSINILGCGSVVFRADDCLASSRRAYRRQRRHIRSTKQRIARMKIILNYLGALTENELNQPGCAWPWQLAARVLQGGKLLTWPELWDVLRWYAHNRGYDGNRRWSAAEAEAQKEDSEKEANARTLMGKYGVHSMAETFCRELGVEPLGKKKSSMKRFKGLNAAFPREVVEGEVRNILQAHSGKLKGVDVNLEKVLFSGWRAIPCPDLKLPKRYEGGLLFGQLVPRFDNRIISICPISGQKVPSRNCPEFLNFRWAMQLANIKVGKVKDRELQPLKVEHRSALDKQMRERGYLTPKELKDAVRSIAGCERDNLDTMLMHPDAKDALLLDPVQKLICSDDLQPFWKLLPERLQKRLRGQWRRGKVFSLTQIRKQLELLDDAGAFDSKLQKQLDTQNTKAKKKDRQVTREELLQKHFPSRPLKLDGRAAFARHLLKQACEDVLAGRPHPKEEGGCLFISEEIRQKQLNREIAEQTNNHLVRHRLLILERLFGDIIKEYAAGKKGRIGKITIEVNRDLREMSGKTAKEKAQDLGLRIANHHAVAEKLEKAFAEERNGKSIRITAGLIRKARIADDLGWKCPYTGQPYEPKHLITRFVDKDHIVPRSDRASDSLDSLVITFSAINKWKGKRTAWQFVSEEQGKPVPDLPNFSILSLARYKQFVETLETYKGHDDDKRRKKKRKELMLLPKYEEKEFVPGDLTQTSQLVRLGAQVLKRVFANSEKKSPVVSLPGSVTGAVRKAWKVLGCLSLANQQVLDENGDVKTKTDIRDITHLHHALDACVLGLTSHFIPNNGRVWELIVKRNPNELEKRELMALGVFGFNAEKRFEMRDLDNKLKEQIRQRLAEKRVVQHIPARMDGLRVEQNTWRVVSSDENGNVTIRQRIRQPDGSRPEKVGEEKATKLLGLKPVNSNGKLAANKGVLIIPDNYGVVLDPVPTIIPFHKVWPRLQELKKANGGKMPRVLRNGQTIKVPEGKYKGVWRVFSAKNNSTGMAVDIGQPDVVRLKNKTEGHKINVLLASLLKNKMQVVKTPFTGIASCPTTSPA

SEQ ID NO: 418 - protein, 961 aa, Unknown
  Description of Unknown: uncultivated organism with predicted taxonomy: Verrucomicrobia bacterium
  MG2-103 effector
YDGNQRWSKNASSESESHTLDDASLDKILSDASATEADKDDAKKVKEAKNLMQKNGTHSMAETFCKELGLHPMGKAKASMKRFKGLNAAFPREIVEGEVRRILKAHFGKLPKVDAHFERVLLGKDNQDKLAWQAIPCPELKLPKRYQGGLLFGQLVPRFDNRIISTCPISGEKVPSRNCPEFLNFRWAMQLANVQVARFGEQKLSPLKPDERADLDKQMRAAGGMTAKQFTEAVRSTTSAIRDNLDTMLMHPDAKEALLLDPVQKVVCSDDLAPFWKLLPERLQKRLRGKWRHGKVFTLAQIRTQLELLGDATAFEVELQNQLDTRNTKTKKKDKQVSREELLQKHFPSKPLKLDGRAAFARHLLKKAYEEVLTGKHPKEEGNCLFLTEEIRKKQQEREIADQTNNHLVRHRLLILERLVGDIVKEYAGGDKEQISKATIEVNRDLREMSGKTAKEKAQDLGLRIANHHAVSDKLEKAFAEEGKRTPITAGLIRKARIADDLGWKCPYTGQDYEPKQLVSRYVDKDHIVPRSQRASDSLDSLVITFGAINKWKGNRTAWQFVEQEQSKPVPDLPNLSILTLTRYKQFVESLETYKGHDDDKRRKKRRKDLLLLPKYEEKTFVPRDLTQTSQLVRLGAQVLRNVLPHLKQNDVISLPGSVTGTVRKAWKVLGCLSLANPQVLDENGDVKTKTDIRDITHLHHALDACVLGLVSHFIPNSGQVWELIVKRNPNDTEKKQLTALGVFGFGKDNRFEMRDLDDRLKEQIRQRLAEKRVVQHVPARMDGLRVEQNTWRVVSIKDGEATIQQRIRQADGSRPLKQTEEKVGKLLGLEPGKLSANKGALVIPDNFGVALDPQPTIIPFHKVWTRLQELKKANSGKMPRVLRNGQIIQVPTGRYKGIWRVFSAKATLTLDLGSPDKVRLESKGDGQKREVQIKTLLQDGMVFQKIPLTGIAACPTTSSS

SEQ ID NO: 419 - protein, 1011 aa, Unknown
  Description of Unknown: uncultivated organism with predicted taxonomy: Verrucomicrobia bacterium
  MG2-104 effector
DAVPDTEKVKNAGELAHDLGTETMAETIAAYTVRYEAAMQAWHRARTAAVTEGKEFKEPKPMVHFKGRNCAFPRESVVWPEVQRLLTALKGKLLNLDDALIRALLGNDVDPLKDREAWKTLPCPALKLPKRYHGGLLFGQMIPRFENRIIGVCPIQFARLEARYLSEGLDAAEAKHRAAKEAKLPAKATPEFLRFRWAMQLANVFGAAPGESKTRPLSAEERRKLTEQAEQRGAFGKVEFKKAVRAVTGWLDKPARDNLDSLLLHPDAERALELDPVQNEIRKSSLRPALDALPDRYRKRLHGKLASGKTVTLAEVRGWLEAGSRRREEAESLAAFDAVLDQEVEKANTKRGKKQEATTRESLLAEKLTAAFPTGRAPYARPILRQAYEEAMSGIDPRAEKSADQPRGVLCQTDELKEAQLHRRLDEQTNNHLIRHRLLILERLLEDLIAAPEFADGDKARVAGLTIEVNRELRDLSGKTRKEQEKDLGIRLKDFKDVAKKVEDACKRRGVSITAGIIRKARVAEDLGWKCPYTGKAFEIDALLGDTMDKDHIIPHADRQSDSLDSLVMTWKEVNTWKGKRTAMQFIREEGGKTVPGRPELSIMPLEPFKKHVASLDTRKGHNDDKARKKRRVQRLLTENYEEKEFTPRDLTVTSHLVRLGAQVLKRHFSDLPREHRIQLEPVSLPGSVTGEIRKAWKLIGCLAVANPQVLNPDGTVKPKQDIRGITHLHHALDACVLGLAAFYFPRHGSLWAAMVKRRPSAEEAALLRQTGFYQTDSEGRFRLIDFPEVLAQQIRQRLAEKRVVQHVPADMGGVLVEENTRGIQGISEDGRRVALRQRAPRDPKTGVRPSAKTTDEAAGKLLGLQPEGGSGKLKRQNGVRVITDNFGVAILDHAPEGEEKFVVIPWHRVWHRLEELKERNGGNRPMLIRNGQLIRVAKGNYAGVWRVFSAKNNTSGMALDIGWPDVVRLQNKTEGHKINVLLASLVKAGLEALPNSLLGLDSRAVCQTAT

SEQ ID NO: 420 - protein, 762 aa, Unknown
  Description of Unknown: uncultivated organism with predicted taxonomy: Verrucomicrobia bacterium
  MG2-105 effector
HGGLLFGQMIPRFENRIIGVCPIQFARLEARYLSEGLDAAEAKHRAAKEAKLPAKATPEFLRFRWAMQLANVFGAAPGESKTRPLSAEERRKLTEQAEQRGAFGKVEFKKAVRAVTGWLDKPARDNLDSLLLHPDAERALELDPVQNEIRKSSLRPALDALPDRYRKRLHGKLASGKTVTLAEVRGWLEAGSRRREEAESLAAFDAVLDQEVEKANTKRGKKQEATTRESLLAEKLTAAFPTGRAPYARPILRQAYEEAMSGIDPRAEKSADQPRGVLCQTDELKEAQLHRRLDEQTNNHLIRHRLLILERLLEDLIAAPEFADGDKARVAGLTIEVNRELRDLSGKTRKEQEKDLGIRLKDFKDVAKKVEDACKRRGVSITAGIIRKARVAEDLGWKCPYTGKAFEIDALLGDTMDKDHIIPHADRQSDSLDSLVMTWKEVNTWKGKRTAMQFIREEGGKTVPGRPELSIMPLEPFKKHVASLDTRKGHNDDKARKKRRVQRLLTENYEEKEFTPRDLTVTSHLVRLGAQVLKRHFSDLPREHRIQLEPVSLPGSVTGEIRKAWKLIGCLAVANPQVLNPDGTVKPKQDIRGITHLHHALDACVLGLAAFYFPRHGSLWAAMVKRRPSAEEAALLRQTGFYQTDSEGRFRLIDFPEVLAQQIRQRLAEKRVVQHVPADMGGVLVEENTRGIQGISEDGRRVALRQRAPRDPKTGVRPSAKTTDEAAGKLLGLQPEGGSGKLKRQNGVRVITDNFGVAILDH

SEQ ID NO: 421 - protein, 1134 aa, Unknown
  Description of Unknown: uncultivated organism with predicted taxonomy: Rothia
  MG3-6 effector
MSTDMKNYRIGVDVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEG

SEQ ID NO: 422 - protein, 1131 aa, Unknown
  Description of Unknown: uncultivated organism with predicted taxonomy: Rothia
  MG3-7 effector
MSEHTKYRIGIDVGDRSVGLAAIEFDDDGFPLSNLAMVTYRHDGGLDPTTNKSPKSRKETRGVALRTMRMRRRKKSRLKDLDKTLRALGYVVPACEEPQTYEAWKSRALLATTKVEGAQELGEHLVRAVRHMARHRGWRNPWWTFNQLEIASTAPSDTFAKIRERAEKEWPGVVPEEATLGMIGALAASNNVLLRPRTYRKDQPRHSKKLNVLGQEPILVDKVRQEDLLAELRTICKKQDIEDQYEKLAQAVFEQTRPYVPLDRVGKDPLQPNKSRASRASLEFQRFRILDAVAHLRVRVGASDRRALTDEEHDKAVHFLMGYSKKDVPTWGDVADEIGVEPAHLIAPVIDDVRLNKAPYDRSSTEFEQKMKKKTRARQWWDEANLESRSQLILLVSDPTDETMRLAEVSGLYEVFESWPDEEKEALEGLKVESGRAAYSTDTLNKLSDHMRLKRIDLHEARKIAFGVDDMWHPPLDRIDEPTGQPTVDRVLTIVRRFIFDCERAWGCPENVVIEHARTGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSLASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVSPLRLRPQNGSVHLDTVDAVLERTIGDAWTVDQVHRIVNPQIYLAFAGYLGNQKALDPDSSRVLALNDGRKLTAEDVIYVFPEKAASILTPRGVVKIGESVHHVRLYAWKNRKGKAEVGMLRVFGAEFPWLMRESGVKDVLRVPIHTGSQSYRDLSFTVRKNIEKGEAAEIGWLTQNEELEFNPESYLQEGGKDKLAKFLAFLPETRWRVDGFPMPDKLRIRPALLSREEIPEGVFRTEEQSLLEEALTKGLIIATKGLLSLPDVKVLRRNNLGIPRWRGGSYRPVSLDIQRAALAALDEQE

SEQ ID NO: 423 - protein, 1132 aa, Unknown
  Description of Unknown: uncultivated organism with predicted taxonomy: Rothia
  MG3-8 effector
MSTDMKNYRIGVDVGDRSVGLAAIEFDDAGFPIQKLALVTFRHDGGLDPTDNPKSRKETRGEARRRMRMTRRRKQRLRDLDKVLENLGYTVPEGPEPETYEAWTSRALLASIKLASADELNEHLVRAVRHIARHRGWVNPWWSLDQLERASQEPSETFEIILARARELFGERVPANPTLGMLGALAANNEVLLRPRAEKKKKTGYVRGTPLLAAQVRQIDQVAELRRICEVQGIEEQYETLRNAIFAHKVAYVPTERVGKDPLAPSKNRTIRASLEFQEFRILDSVANLRVRTDSRAKRELTEGEYDAAVEFLMGYTAKEQPSWADVAEEIGVPGNRLIAPVLEDVQQKTAPFDRSSAAFEKAMSKRTEARQWWEANDDDQLRSLFIMFLADATNDTEEAAAVAGLPELYMSWPAEEREALSNIDFEKGRVAYSHETLSKLSEYMHEHRVGLHEARKAVFGVDDTWRPPLAKLEEPTGQPTVDRVLTILRRFVLDCERQWGRPRAITVEHARIGLVGPAQRQNILKEQEDNRKNNECIRDELRKSGVENPSRTEVRRHLVVQDQESQCLYCGAVIRTDTSELDHIVPRAGGGSSRRENLAAVCRYCNSKKDRTLFYDWAGSVRLQETIDRVRQLKAFKDSKKAKMFKNQIRRLRQTEADEPIDERSLASTSYAAVAVRERLEQHFNEGLAPDDKNRVVLDVYAGSVTRESRRAGGIDERILLRGERDKNRFDVRHHAIDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEG

SEQ ID NO: 424 - protein, 1050 aa, Unknown
  Description of Unknown: uncultivated organism with predicted taxonomy: Dermabacter hominis
  MG3-1 effector
MRKRKRQRLKALDRYLAEHGYPDVQPQITPYDAWHARARLVSTKVDDPAQLKNDLALALRHIARHRGWRNPWKTLASTRKLPVPSETLLANQARAREHFGDEVNDSTTVGQIGALAASRDYLLRPRNITVTKGVNQKKNVNDLERSSEEALAAGHPTAPILGWQVRQEDQINEVERIWERQGLPSEELPQILTLLFAQTKPHVPSERVGRDALQPKLYRAPIAALEFQDFRILAAIANLRVRTEGGRRLTKDERFTAFQFMSGWREKEPLSWADVAEELGFSAHALAAPTTETNQRLAFAPTNRTLTTLGTFFKGKKIDAGAREWWQSASYAERSLLAQLIADATPDTQEQADASGLSDVLLQWDEDTVADLMELDLQSGRAAYSTDTLLRLNARMENDGTDLFESIQAEFNIDPSRLPRPDWDDQTGQPTVDRVLTIVRRFVGGCERKYGKPESVTVEHVRTGLMGAEQRSSIIAENNRNRRDSDRIRAELQADGLSEPSRLDVRRHRQVQRQNCTCLYCGTPITTTTSELDHIVPRRGGGSSQGSNLVAVCRECNASKAHRIFAEWAEDSQREGVSVKEAAKRVRHWLNASASMKREVTRRLQQKRTDPPIDERDLASTSYAATEITRRILGHFHDEVPVVAFGGSGTREARRAGRVDHIIRLRGSLDKSRLDTRHHAIDAAVLTLQSPAIYRVLLTRVNLKHEHEVTGEAPEWRDYEGADQAEKVLYRRWQKNIATLAELMRQEIENNRVPVTRPIRLRKSRGAVHDATVMKALERDLWGEWDAQAIDRLVDPELHLALRKLFTSTKSKKIDVDATSQGLPERYLANQTVQLFDADAPSVMSPRGILRIGAGTHHARLLTWDDPKKGPQLGIQRVFAAEFGEILKDASSNDLFEAPIPFHTMSHRDLQPKVRAAVEQGLTRQIGWITQGDELEIDPADFVGEANAFGNFLREFPERSWSIAGLKKSNTIVIRPLLLSQEGVTAAISPHAAKIVENGIELSNSTLFTAPGTGIIRRTGLGRPRWDSGPAHLPESFNVHARMTQQSARD

SEQ ID NO: 425 - protein, 1134 aa, Unknown
  Description of Unknown: uncultivated organism with predicted taxonomy: Micrococcales
  MG3-5 effector
MCINGDSMAAVSGFSPCKFGIGIDVGDRSVGFATIEFDDDGFPLSVLASVSYKHDGGLDPTKNKNPISRKATAGVAHRVRRMRKRRRRRLEMLDVKLRSLGFPVPNGEEPQTYQAWQSRAKLIDGRVDEVRELNDHLVRAVRHIARHRGWRNPWWRFPQLLEASENPSDALVAMRREAAQRWPGQALESATIGQLGWLGAHPDVLVRPRSARSEVPVLSSRVMQQDQCAEIRRYWQLQDLPQEALHPILKAVFHQEPPTVPAERIGRDALPGQDAPRAIRAALEFQEYRIRDAVANLRVRTGGANRKRKLTPEENHAVVKYLMEFRQNPSPSWAEVAEHIDIAPTSLIAPIIDDMRIAAAPTDRSTITAEAVLSNMKKDSGARLWWESADQKMRSLLIRFLADTSDYTQPEAEMAGLVDIVSTWPDSEIEKLSSASWQSGRAAYSLQSLERMNAYMAEYSTGAHEARKGVFGVDDSWKPEADPWDAQTGQPVVDRVMTIVRRFVGACERKWGEPERIVIEHVRTGLMGPAQRAEVLREMASGRRKNDRIRQELRTSGIDEPNLSDVKRHRKIQMQGGVCLYCGTDITSATAELDHIVPRAGGGNSTSTNLVAVCRVCNAAKGRRTFPEFASSDTRDAVSLEAAVERVKLWIDDKGIKNIGESRYARDVIRRLKQSTQDEPIDERSLSATAFAAVEIRRKLENHFKDRTKPVRVDVYRGALTRESRRAGRIDAKIRLRGNIDKDRLDIRHHAIDAAVLTLLDPSVAKTLAMRLDLKREQQDSGRDTRWKEFKGLTPASQERFIKWCQASECLADMLRQQIEADRVPVVVPLRISPSNGAVHDDSVRPLTRQKIDSTWDRKSINRIVDPEIHVAMRRLLNNGTSLPEDKNRVLDLPDGNELGPHDEVELFSTSAASIKLRRGGSAEIGGSIHHARVYAWMGAKGQLEYGMMRVFGAEFPTLTKLSGSKDILRMPIHAGSMSYRDMQDRVRKPIESDIAVELGWITQGDELEILPEAHLETAGGLGDFLKSFPETQWTIDGFNDPSRLRVRPRLMSLEGRDTIDAMGHLSDTEKLKIKQALSKGLMVSASELLSHGAKIIRRDHLGRPRWRGNARPVSIELEQVANQLVNHRSVDGQ

SEQ ID NO: 426 - protein, 1132 aa, Unknown
  Description of Unknown: uncultivated organism with predicted taxonomy: Rothia
  MG3-6 effector
MSADSLNYRIGVDVGDRSVGLAAIELDDDGFPLKKLAMVTFRHDGGKDPATGKTPKSRKETAGVARRTMRMRRRKKKRLKDLDKKLRDLGYFVPRDEEPQTYEAWSSRARLAESRFEDPHERGEHLVRAVRHMARHRGWRNPWWSFSQLEEASQEPSETFGRILERAQHEWGERVSDNATLGMLGALAANNNILLRPRRYEHNPKTGKNAEKLNVRGQEPILLDKVRQEDVLAELRRICKVQGIEDQYPELAHAVFTQVRPYVPTERVGKDPLQPMKIRASRASLEFQEFRIRDAVANLRIRVGGSERRPLTEEEYDRAVDYLMEYSDTTPPTWGEVADELEIAENTLIAPVIDDVRLNVAPYDRSSAIVEAKLKRKTQARQWWDDDANLDLRSQLILLVSDATDDTARVAENSGLLEVFESWSDEEKQTLQDLKFDSGRAAYSIDTLNKLNAYMHEHRVGLHEARQNVFGVSDTWRPPRDRLDEPTGQPTVDRVLTIVRRFILDCERAWGRPQKIVVEHARTGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLERTIQRLRELQAFKTKSKKRTLNAIIRRLKQREEDEPIDERSLASTSYAATSIRERLEQHFNDDLPDGFAPVAVDVYGGSLTRESRRAGGIDKSIMLRGQSDKNRFDVRHHAIDAAVMTLLNPSVAVTLEQRRMLKQENDYSSPRGQHDNGWRDFIGRGEASQSKFLHWKKTAVVLADLISEAIEQDTIPVVNPLRLRPQNGSVHKDTVEAVLERTVGDSWTDKQVSRIVDPNTYIAFLSLLGRKKELDADHQRLVSVSAGVKLLADERVQIFPEEAASILTPRGVVKIGDSIHHARLYGWKNQRGDIQVGMLRVFGAEFPWFMRESGVKDILRVPIPQGSQSYRDLAATTRKFIENGQATEFGWITQNDEIEISAEEYLATDKGDILSDFLGILPEIRWKVTGIEDNRRIRLRPLLLSSEAIPNMLNGRLLTQEEHDLIALVINKGVRVVVSTFLALPSTKIIRRNNLGIPRWRGNGHLPTSLDIQRAATQALEGRD

SEQ ID NO: 427 - protein, 1134 aa, Unknown
  Description of Unknown: uncultivated organism with predicted taxonomy: Rothia
  MG3-7 effector
MSTDPKNYRIGVDVGDRSVGLAAIEFDDAGFPIQKLALVTFRHDGGLDPTKNKTPVSRKKTRGDARRTMRMNRRRKQRLRDLDMMLTNLGYTVPEGPEPETYEAWTSRALLASIKLANVDELNEHLVRAVRHMARHRGWANPWWSIDRLENASREPSETFEIILARARELFGEKVPADPTLGMLGALAANNEVLLRPRDGKKKKTGYVRGTPLLVAKVRQEDQLAELRRICEIQGIEGQYDALRSAIFTHKMAYVPTERVGKDPLNPSKNRTIRASLEFQEFRILDSVANLRVRTDSRSKRELTEAEYDVAVEFLMSYTANEQPSWADVAEVIGVPGNRLIAPVLEDVQQKTAPFDRSSAAFEKAMGKKTEARQWWESTDDDQLRSLFISFLVDATDDTEEAAAEAGLPELYMSWPAEEREVLSDIDFEKGRVAYSQETLSKLSEYMHEYRVGLHEARKAVFGVDDTWRPPLDKLDEQTGQPTVDRVLTILRRFVLDCERQWGRPRAITVEHARTGLVGPAQRQEILNEQKKNRENNELIRGDLRKSGVENPSRAEVRRHLIVQEQESQCLYCGAVIRTDTSELDHIVPRAGGGSSRRENMAAVCHYCNSKKKRTLFYDWAGPVKLQETVDRVRQLEAFKDSKKAKMFKNQIRRLKQTEADVPIDERSLASTSYAAVAVRERLEQHFNEGLAPDDKSRVVLDVYAGAVTRESRRAGGIDERILLRGERDKNRFDVRHHAIDAAVMTLLNRSVALTLEQRSQLRRAFYELELDKLDRDQLKPGEDWRNFTGLYEASQNKFSEWKKAATVLGDLLAEAIEDDAIAVVSPLRLRPQNGSVHDDTINAVKKLTLGSAWPADAVKRIVDPEIYLAMKDVLGKLKELPEDSARSLELSDGRYIEADDEVLFFPKKAASILTPRGAAEIGNSIHHARLYSWLTKKGELKFGMLRVYGAEFPWLMRESGSRDVLHMPIHPGSQSFRGMQDGVRKAVESGEAVEFGWITQDDELEFDPEDYIAHGGDDELNRLLRVMPERRWRVDGFYNAGTLRIRPALLSAEQLPSELQKKVADKTLSDVELILLRAVQRGLFVAISSFLPLESLKVIRRNNLGFPRWRGNGNLPTSFEVRSSALRALGVEG

SEQ ID NO: 428 - protein, 1132 aa, Unknown; identical to SEQ ID NO: 423
  Description of Unknown: uncultivated organism with predicted taxonomy: Rothia
  MG3-8 effector

SEQ ID NO: 429 - protein, 1110 aa, Unknown
  Description of Unknown: uncultivated organism with predicted taxonomy: Brevibacterium
  MG3-42 effector
MNKDYAVGFDVGDRSVGVAFVEFDGDVPVKLLRAVAYRHDGGIDPTTNKTPQSRKATAGVARRVRRMRKERRRRLNELDKFLRQAGYPVEGDDRGETYEPWKARANCVTGFIEDEAQRKLELSRAIRHMARHRGWRNPWHTVSQELREHVPSSQHQKNVANAQEIFPGELDANATVGQLGAVAGKYNRLLRPRTNEKAKESGLIPVLSYKVLQCDQLDELQRMCKMQRLDEDFESELLELVFGQKRPVVRAENIGRDELPGMNGHPRAPRSSLEFQEFRIRDSIANLRVKSSRRDRKGVGLASEVVNNVVDYLLEWREPDDPTWAEVAELIGVDPDLLVAPVFDDVRRMIAPVDRTSRLLEKTLSKKAFKPVLEWWNNTSFEQKSMLVALISDPTDHHEDWAVSAGIADVIASWPDGLLEELNSLNFESGRSAYSLLSLKKMNDCMAIRGCNLHDARKEVFDVDDSWRPTPPKIHEPVGHPTVDRVLPIVRRTIMEAHRRWGVPRSIHIEHTRSSLLGPAARAEYQREVNANRRARERSLESLREQGVADPTVATVRRFSAVQHQNGVCLYCGSAITAKPGDSGCELDHVVPRSGGGSSKRENLVAACRRCNSEKGNLPFSLWAAESTRPEVSVEAALTRLQNFNWERRDRAVKKGLIRRLKQTSEDEPIDERSLESTAYAATEIRRRLQYYFEENCGANSPQPEILVLPGAVTREARRAGGFDSRIKLRGKNDKDRFDARHHALDAAIMTVVDRSVARTLQQRSDLKYSNFLTGAEPRWKDFKGDSPESRKKFERWVQTSNRLADLVSDAIVTDSIPVIFPLRLGTNRGPLHKDTVRCADWKPIAEEWSEKEIERIVSPDVHAAVTEAIGLKGGKLSATSCSNVILQNGKFGEKVALAKSSAACIQVNGGVVEIGESIHHARLFAWRGRRGAIEMGMVRVFTAELPYILKNSTHGDVLTATIPASTFSFRNTPATLRKKLLAGEAVSVGWLTQNDEIEIEVDEFACGNTSFAKFLTEIPEKRWRVDGFYDNRRLRIRPAYLSAEGLTDNHSKVVHETLEKGQFVNAGALLSASRTLLIRRTALGAPRWKLDSSGLPVSFSPLKLAEEAL

SEQ ID NO: 430 - protein, 819 aa, Unknown
  Description of Unknown: uncultivated organism with predicted taxonomy: Brevibacterium mcbrellneri
  MG3-68 effector
MNKDYAVGFDVGDRSVGVAFVEFDGDVPVKLLRAIAYRHDGGIDPTTNKTPQSRKATSGVARRVRRMRKERRRRLNELDKFLRQEGYPVEGDDRGETYEPWNARANCVIGFIEDEAQRKLELSRAIRHMARHRGWRNPWHTVAQELREEVPSSQHQKNVANAQEIFPGELDANATVGQLGAVAGKYNRLLRPRTNEKAKESGIIPVLSYKVLQCDQLDELQRICRMQRVGEDFESELLELVFGQKRPVVRAENIGRDELPGMNGHPRAPRSSLEFQEFRIRDSIANLRVKSSRRDRKGVGLASEVVNDVVDYLLEWREPDDPTWAEVAELIGIDPDLLVAPVFDDVRRMSAPVDRTSRLLEKTLSKKAFKPVLEWWNNTSFEQKSMLVALISDPTDHHEDWAVSAGIADVIASWPDGLLEELNSLNFESGRSAYSLLSLKNMNECMATRGCNLHDARKEVFDVDDSWRPTPPKIHEPVGHPTVDRVLPIVRRTIMEAHRRWGVPRSIHIEHTRSSLLGPAARAEYQREVNANRRARERSIESLREQGVADPTVATVRRFSAVQHQNGVCLYCGSTITAKPGDSGCELDHVVPRSGGGSSKRENLVAACRRCNSEKGNLPFSIWAATCTRPEVSVEAALVRLENFNWEKRDRAVKKGLIRRLKQTSEDEPIDERSLESTAYAATEIRRRVQYYFEENCGANVPQPEIFVLPGAVTREARRAGGFDSRIKLRGKGDKDRFDARHHALDAAIMTVVDWSVARTLQQRSDLKYSNFLTGAEPRWKEFKGDSPEARKKFERWIQTSNRLADLVSDAIVAAAIPV

SEQ ID NO: 431 - protein, 1110 aa, Unknown; identical to SEQ ID NO: 429
  Description of Unknown: uncultivated organism with predicted taxonomy: Brevibacterium mcbrellneri
  MG3-88 effector

SEQ ID NO: 432 - protein, 1055 aa, Unknown
  Description of Unknown: uncultivated organism with predicted taxonomy: Planctomycetes
  MG4-5 effector
MGDQQTLQATSYCLGLDVGVQGVGWAVIDLDDQGQPLGVRRTGVRCFDSGVGSETEFEKGVDEPPSTKRRQARQQRRQLWRRAQRQRRVFRALQEAGLLPPGPPTPVSRDKILRTLDADLAIQFGSLEDRIAAHLLPYRLRALALDTPLPPYALGRAFYHLAQRRGFLSNKKALKEEKEAGEVKKGIAELQEEMNRAGARALGEYFSSLDPEQRRIRNRWTARQMYLDEFDRVWEAQSRYHPRLTDELKTKVRRAIFFQRPLKSQKGLIGRCELEPRHRRAPLASLLAQRFRYWQKINDLEVIQPDGVVRPLSPEERHKLAHFLETQAEATFARIRKLLDLKKPKGSQEDFAFNLERGGEKRILGNRTAAKMAAVLGQRWAAMDDEDKRRLVNEILSFEKEAPLARRLVRAWNLDEPTAAQLAALDFEPGYAALSARAIRKLLPLMQREGMRFATARKQVYGDHLLGTRAYDALPPVAKAIPSLRNPAVCRALTEVRKVVNALVRAYGKPAMVRIELARDMKRGRKQRKETWQAMRENERCRLDARKLLQDHGIQEPRPADILKVLLAEECNWECPYTGKAISMDALIGSQPQFDVEHIIPFSRSLDNSFLNKTLCYHEENRNVKQNRTPFEAYGGDEQRWHEILQRVRRFRGSAAESKLRKFQLRQLPADFTNRHLNDTRYASRLAADYLALLYGGRVDANGRQRVQVGTGATTGFLRDEWGLNAILGDNDEKERADHRHHAIDAVVIALTGPGTVQALTRAALRAKELGRRLFVPLDPPWADRDSFLRDVRASVEAITVSYRVDRKVSGQLHEESNYSKPHMTVDNKGNLVEHRHIRKPLKDMSVEEVEAIVDDRVRKLVQEKLRQLGQEPKKAFADEANHPYFTTADGRLVPIHKARIRKTVATITVGPPQCPRHVAPGLNHHIEILAVRDPAGAVTHWEGELVSLFEAARRVKAGEPVVRRNHGPNKDFLFSLAKGEYVEMELQPGKRQLFRVTVISAKQIEFRLHHDARPTMLLRKTPGARVIRSPGSLFKAKARKVAVDPLGNVFPAND

SEQ ID NO: 433 - protein, 1026 aa, Unknown
  Description of Unknown: uncultivated organism
  MG4-11 effector
LVGYEKSFFLGDLSKWQPVSAGMVAKGNLEGGPYLNYPGPLDRGPGRWTARAYSNVGRADHNQVLNKQNRKNLSMNKKNSYVLGLDLGTASIGWSIIPLDSAAIDADNINMGVVIVDEPVDKKKKTPLNVDRRNARQQRRMKDRKNRRKVHLFNCLQRAGLLPSTPCHTPFQRQDLLNELDSTHYGLDMSGNDLDLLLYRLRAMALDEKLELYAIGRILYQLAERRGFKSNRKDTTKDNEDGEVKKAIAGLGEEIDKAGSRTIGEHFAAYDTTQKKIRQTYTSRQWYEDEFDLIWAKQSSYYPDMLTDALRKEIRDIIYYQRPLKAPKRGMCDLEKGQVRVSKSDVAFQRFRYWQVLNNLEVADGHSSFRPLRAKEKAVLVQKLEVTKKVTYKAIKKLLGFSESAVFNYEAMTDTIPGNSTIASVYAVLKDKKTKPSLELCATIAEKILAFEDTGALVKNLVRKYHINRDVAEKLAGLEFEDGVAMHSKQAIERILNKMKHEGKSYATALKELYPDRNRADKVYDLLPPVDEWTKGSTKITNPSVHRILTQLRKLVNALVREYGKPALIRIELARDLKHNVKTKSKIIAQIKSREEEREAARKGLADLGIDNPTPANIKKWVIAERCNWTCVYTGKRADKRVEFGPHPQFDIDHIQPYSRSGNDSLGNKVLCFSAENRHVKKNQTPLECYGDDEERWNEIMGRVSAITGPDRVKTYRYFITTAEENEGFTARSLTDTSYISKKAVEYVSLLFGGSIDAKGKRRVFATKGGITGRLRREWGLNVLLGGEDEKNRADHRHHAIDALVIALSTPAVIKKIGGEDTRPKEDILPPIDNLADVAREVLEKVNVVYRCSQKIRGELHDAGIERYPGRKQKRKGEVYCIGTAERTKRYVHLNSNHHMEVVEGKDGRWEAVTVPRMEVYQRCRAKRPIVNRNHGDKWYVCSLAIGDYFTVDGGEKKLYVVKMLSGQVVGYMEHNDGRLQKTSGDDMSVFRTSINKLRQKGFRKVQLDVMGRLAVGKERCPTPQF

SEQ ID NO: 434 - protein, 1111 aa, Unknown
  Description of Unknown: uncultivated organism
  MG4-12 effector
MPNSNAPYVLGLDLGIASVGWAIRPINPSDITVDNLKMGARIFDLAVEDDIEKGKDKPKNATRRDARSARRRLWRRRRRKLKIFNLLVRYGLLPEGDYPTPDARQDMLSALDLQLVKEYFPNATHHDQQTFTYALRALALDRELSPHAFGRALYALAQRRGFKSNKKLDGREKEGEKETSQIKQDIAELEKNVAEHARTLAEYFTTVNPEEERIRARWVGRKSYEEEFEAIWTAQARFKPELLTDELKAKIEDAIFFQRPLKSQKGKIAKCELELDENGKRYLPVARKGEPCFQKFRVWEKIINLRVWDDAVDGRYGGGWRPLTHQEQDAAYELAEKSEKVTYKALRKELGFKSIKGVKKGEAVFETGYFNLEVAEDAMIGDRTSARIWKVLNETGDTLTQEEVDQAALYILDYESEDGLRRRLLKSFPTLSDAAATKLAYDVVLEEGYGAYSSVALNKLLAVMTKKRVNQALAKMEVYKAQYGEACDLLPPLEEAVGDIRNPTVTRTLAEMRKVVNAIIRRYGKPAQIYVELARDLKRSRKQRDEIFRKNQARKKERENIEKTLQNEFYIKSPKGRDVLKYRLWKECGGICPYTGMVISPDDLFGPNSRFDIEHIIPFSRSMDDSFANKTLCYAEENRNVKKNQTPIECYGDSPKFREILERVRKTFTGEFKFRKLKLFETQEPESITEFSKACLNDSRYMSKLALRYLGVLYGAVNGCVGGQDEDEGGKRVIFASTGKVTAWIRREWRLNEILCDDDEPTGEGADVEKNRNDHRHHAIDALVISLSTPSYVQQLNRAAQLADNDAKARLFKKGNFMPPVTGFKALVAQVVDGIVVSKRVDSKVRGALHEETNLGAIAYPDPYTKKQRRKKRVFVTGLTSSKLLDSVVDPGVRRAIAEKLEEVGDAKKLADNPPRLPAHNRNFGVLIVKTAIWETNNPIRVGKGRSARFVKSGDNHHMEFYAVLDDKGNEIEWKFNIVSLYEAYERRRKHLPIVSRDFGPKTRFKFSLVKGDAIREKATGKIYFIAGLSTQGEGKGIYITGALNTCAKPVTVIKEEYSKMSKMKRGVAQGDMKGLPKEVAYFRSTNLVDLMKRFEKVRIDPLGNVERSNS

SEQ ID NO: 435 - protein, 1102 aa, Unknown
  Description of Unknown: uncultivated organism
  MG4-13 effector
MEQKESYILGLDLGANSIGWALLEAHPDPEEKGRLKAHGIKQIGVRIFEAGVEGEIEQGKDQSRAVDRRDARLARRRLDRISRRLSHLFYLLMSAGLLPEHPAYKTELGKKKSAKERKQERDLKAKARHEVINQLDQDLVKKWREKEPLAKETLPYILRAKALDEKLELYELGRALFHLAQRRGFLCNRKAKAKDDEELGKVNQGILELEGKIEGAGARTLGEYFSKLNPKEERIRSRWTSREMYLKEFEQIWNAQEKHYPKILTPEFKKKIWRCIFYQRPLKIQHHLIGECQYEKGKKRAPSACLAFQRFRMLQQLNNSYLISPDGEILNDGRLTKEQRERLIEVLEKKAELKFSKAKKILGLTKEYRFNFEKEDGKGEFLGNETAEKLIKVFGEERWSRFSEQEKNEIVQDLISIQHKSGLVKRGKNKWGLDDENAEEFSKINLEEGYCGLSRLALSKLIPLMETGLTYMEAVKQVYPDRLQNEAFDQLPMVINQMPELKNPVVKRVLTELRKIVNAIIRKYGKPEQIRIELAREMKKTRQQREEIWKKNKQNEEKRKQAAQAIIKEAGENPKPADIEKYLLWDECNGICPYTGKSISLKQLFSGEVDVEHIIPYSICLDNSYFNKTLCFHDENAKVKNNKTPWQAYGSDEKKWNEILERVKRFKGDAAKEKLKKFQIKDLEELDDFISSQLNDTKYASKLAKKFLGLLYPGQEALSRVQATKGGITANLRDVFNLNSILKDGDSVERDGYEPKKTRADHRHHAIDAICIALTEPSTVKMLSEASSRALKERKRRFGKVQPPWENFWEDVKKAIDNTIVSHRVSKKVNGPLHQETFYSPPKEVQGKIICHVRKPLENLSAGDIEDIVDPVVKKKVQEKIKELGGGDPKKLFAGSSTLPPEKLPCMTAKDGRVIPIRKVRIKCVMTPFQVGDKGRERFVTSDTNHHLEIFETKDKKGNVRWDGAIVSQYEAMRRLRAGEPIVKREHGKGKEFKFSLALNECVKLLDEKGQEIVCVVKGISQLSAGPIVITLRHICDARPTSEYQKQIKMRKELKKNYDKKLAEEIEKMLPVFIFKGPDSLREAKGQKILITPLGEIRTAND

SEQ ID NO: 436 - protein, 1047 aa, Unknown
  Description of Unknown: uncultivated organism
  MG4-14 effector
MAQLPFSDYVLGLDIGANSLGWALVSLKDGIPQSILKVGVRVFEAGVEGDIESGKDQSRAAKRREARLHRRMLERRSRRLAKIAGLLQRAGLLPDGDLKSEESRIKVLRELDDSISARHHPTSEKPDPASAHLLPYRLRALALDQKLHPFELGRALYHLAHRRGFLSNRKAPAKDPNEEGKVNQGIHTLRQKIEESGARTLGEYFSRLDPEQERIRQRWTARDMLDQEFEAIWNAQAKHHPTILTHDFKKQLRRAIFHQRPLKIKKNLIADCELEKGQKVAPRCCLLFQRFRLLQQVNNLKVTEPTGKSRPLTRDERETLLHALETQDKLSFSEIKRLLKLRDHRFRMGEGDEEVLTGNKTAAKLREIFGDRWDELSPQERDRVVEDWWSIQKSETLRKHGVKYWRLDPEAAERLGKLALETGYCKLSKKAMRKLLPLMEEGISHAKAQEQLYGNEPPPKPFDKLPPLDRAPLPKPHNPAVHRALTEVRKVVNAIIRRYGRPSLIRVELARDLKKSKEDRKKISDQIARNRRDRERAKKALIDNGIQEPSRDDIEKWLLYEECNGICPYTGKSISLASLFGPNPQFDVEHIIPFSRCLDNSFTNKTLCDIEENRNRKRNQTPYEAYGADPARWEEIIQRVKRFRGKAAAAKLHRFQLESVDSLEEFASKQLNDTAHASRSALRYLGLLYGSNKAGVGPDGRRRVQAGRGQVTAFLRDEWRLNSILGDLQKSRADHRHHAVDALAIALTDSRIIKTLSDAASRALSERRRRFGRVAPPWKSFLEEAKNAIAATIVSHRVSRKVSGALHEETIYSKPHTDKDGRVCHHIRKRLDKYFTRPMLDKIVDPVIRDIVRKHFQANGSDPKKAFSDPGNHPFLCAKDGRHIPIHSVRVREDRSTVQVGSGVSRRQVLTGSNHHVEIVEVEDEKGQPRWEGRIVTLIEAIKRLRNRQPIVQRDHGEGKKWVFSLAGGETIQLTDGGITKLYTVRTITVRRGQYVEIAYVPISDARTKTEIREKKEWRTDLLEPLRKLQCRKVLVTPLGEVRYARD

SEQ ID NO: 437 - protein, 943 aa, Unknown
  Description of Unknown: uncultivated organism with predicted taxonomy: Thermogutta terrifontis
  MG4-15 effector
MKTKNGQVDYVLGIDLGVVSLGWAAIEIDNDGGQSLLGAGVRCWELSNASLEEVEKGKEEPPGQSRRQARRLRRQMFRRAQRLRRTYRVLQEMGLFLTGPRSSTARKAYLETLDQKAQEWLRTNVPDANDDGLLAHTFIYRLRAAALDHPLPPELLGRVFFHLAQRRGFLSNRRTLEKNKDEELGVVKQGISQLQDEIQKSGARTLGEFFSRLNPHEQRIRNRYTSRKMFQDEFEQIWNAQRSHHPNSLTDSKKARLYKAIFFQRPLKLQHGLVGRCPLEVLPRKRPNGQVEYIYPFRRAPMASLEAQRIRYMQRINDLEFTDPQGQRRVLSPEERQKLYDLAERNEDLSFTLIKKTLGIPTGKKGEGWECNLERGGEKKLPGNRASAQIRKVIDDATWEDLGRERQKALVDTLIAFLRADTLEEHLHRVWGFNREVASQLAGLPLEQGYHSFSRRAIRRLLPLLEQGERLNAAIQKVYGGTQRKINQHAELPPVRQVLPTVRNPLLIRALTELRKVVNAIIRKYGIPRCIRVEVARELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLVRFQAEEIPPDFALRQLSDTRWISKAAADYLGHLYGGRIDPTGQQRVFTVAGGLTGLFRRAWNLNAILGGSPEKNRYDHRHHAIDAIVVALTDPSMIQRFAHEASRLLKAWPRVAVRLDPPWSTFLSDVQRHVEGIVVSFRVSRRLSGALHDQTYYAPPTEQGKTKVRKPLREMSSHEVERIVDPTVRDLVKEKLKRLGTSDPKKAFATDANLPIIRGKNNTALPVKSARIWVSSSVIAVGDGPRQRYVVPGNNHHIEIYALLDG

SEQ ID NO: 438 - protein, 1062 aa, Unknown
  Description of Unknown: uncultivated organism with predicted taxonomy: Thermogutta terrifontis
  MG4-16 effector
MKTKNGQVDYVLGIDLGVVSLGWAAIEIDNDGGQSLLGAGVRCWELSNASLEEVEKGKEEPPGQSRRQARRLRRQMFRRAQRLRRTYRVLQEMGLFLTGPRSSTARKAYLETLDQKAQEWLRTNVPDANDDGLLAHTFIYRLRAAALDHPLPPELLGRVFFHLAQRRGFLSNRRTLEKNKDEELGVVKQGISQLQDEIQKSGARTLGEFFSRLNPHEQRIRNRYTSRKMFQDEFEQIWNAQRSHHPNSLTDSKKARLYKAIFFQRPLKLQHGLVGRCPLEVLPRKRPNGQVEYIYPFRRAPMASLEAQRIRYMQRINDLEFTDPQGQRRVLSPEERQKLYDLAERNEDLSFTLIKKTLGIPTGKKGEGWECNLERGGEKKLPGNRASAQIRKVIDDATWEDLGRERQKALVDTLIAFLRADTLEEHLHRVWGFNREVASQLAGLPLEQGYHSFSRRAIRRLLPLLEQGERLNAAIQKVYGGTQRKINQHAELPPVRQVLPTVRNPLLIRALTELRKVVNAIIRKYGIPRCIRVEVARELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLVRFQAEEIPPDFALRQLSDTRWISKAAADYLGHLYGGRIDPTGQQRVFTVAGGLTGLFRRAWNLNAILGGSPEKNRYDHRHHAIDAIVVALTDPSMIQRFAHEASRLLKAWPRVAVRLDPPWSTFLSDVQRHVEGIVVSFRVSRRLSGALHDQTYYAPPTEQGKTKVRKPLREMSSHEVERIVDPTVRDLVKEKLKRLGTSDPKKAFATDANLPIIRGKNNTALPVKSARIWVSSSVIAVGDGPRQRYVVPGNNHHIEIYALLDGQGQEVRWKGKIVSLYEAYERKKRGEPVVCRDHGPNTRFKFSLAKSEYIEWINDDGQKQLLRVVGISDDNLELRLPHDARPITLIREQRERIRATYRQLFQRRARKVMVTPLGEVLPAND

SEQ ID NO: 439 - protein, 1060 aa, Unknown
  Description of Unknown: uncultivated organism with predicted taxonomy: Thermogutta terrifontis
  MG4-17 effector
MNTKNGQVDYVLGIDLGVVSLGWAAIQIEGNGGRSLLGAGVRCWDLSSGSLEKVEKGKEEPPGQLRRQARQLRRQMYRRAQRLRRTFRVLQDMGLFPAGSCSSMARKAYLEKLDRQAQQWLRQHVPNSDGGGLLAHTFIYRLRAVALDHPLPAELLGRVFFHLAQRRGFLSNRRDSQKEEERGVVKQAISQLRADIEKLGARTLGEFLSKLNPHEQRIRNRYTSRRMFQDEFEQIWNTQRRHHPNSLTDSNKARLYKALFFQRPLKSQRGLVGRCPLEVLTRNHSNGQVAYIHAFRRAPMACLEAQRIRYMQRINDLEFTDPQGGARLLSPDERQKLYDLAERNEDLSFTVIRKALGIPTGKKDQGWQCNLERGGEKKLPGNRTAARIRKIIGDVAWENLGSVKQKPLVDTLIALLSPDALTEHLRTVWGFDCKIASQLAELQLEQGYHSFSRRAIRRLLPLLEQGERLNAAIQKVYGGTRLRITQHLKLPPVRQVLPTTRNPLLVRALTELRKVVNAIIQKYGIPQFIRVELARELKRSRKERAEISKRMREQQKRREEAAQKVLEELGRTATPRDIEKYLLAQECNWQCPYTGRQITVQSLLGDDPQFDVEHIWPLHRSLDDSFMNKTLCYHHENRSVKAGRTPYEAYATDPLRWQEILSRVRSFRGPFARQKLDRFQAVEIPPDFAMRQLNDTRWISKAAADYFGYLYGGRIAPTGQQRVFTVTGGLTALFRRAWNLNAVLGGNPEKNRYDHRHHAIDAIVVALTEPSMIQRFSNEAEKLIKAFPRVAVRLDPPWDTFLSDVQQHVERIVVSFRVNRRLSGALHDQTHYSPPVEEGKTKVRKRLNALSAHEVERIVDPEVRRLVQEKLKQLKMSDPKKAFATDVNLPIIHGKNHTALPVKSVRIWVNSLVIPVGDGPRRRYVVRGNNHHIEIYAVLDGQGYEIEWKGKIVSLYEAYERKKRGEPVVCRDHGPNTRFKFSLAKSEYIEWIRIDGQKELVRVVAISDNKLEFRLPYDARPSTLIREAHERIFATYRQLFERRARKVLVTPLGEVLPAND

SEQ ID NO: 440 - protein, 1062 aa, Unknown
  Description of Unknown: uncultivated organism with predicted taxonomy: Thermogutta terrifontis
  MG4-18 effector
MKTKNGQVDYVLGIDLGVVSLGWAAIEIDNDGGQSLLGAGVRCWELSNASLEEVEKGKEEPPGQSRRQARQLRRQMFRRAQRLRRTYRVLQEMGLFLTGPRSSTARKAYLETLDQKAQEWLRTNVPGANNDGLLAHTFIYRLRAAALDHPLPPELLGRVFFHLAQRRGFLSNRRTLEKNKDEELGVVKQGISQLQDEIQKSGARTLGEFFSRLNPHEQRIRNRYTSRKMFQDEFEQIWNAQRSHHPNSLTDSKKARLYKAIFFQRPLKLQHGLVGRCPLEVLPRKRPNGQVEYIYPFRRAPMASLEAQRIRYMQRINDLEFTDPQGQRRVLSPEERQKLYDLAERNEDLSFTLIKKTLGIPTGKKGEGWECNLERGGEKKLPGNRTSAQIRKVIGDATWEDLGRERQKALVDTLIAFLRADTLEEHLHRVWGFNREVASQLAGLPLEQGYHSFSRRAIRRLLPLLEQGERLNAAIQKVYGGTQRKINQHAELPPVRQVLPTVRNPLLIRALTELRKVVNAIIRKYGIPRCIRVEVARELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLDRFQAEEIPPDFALRQLSDTRWISKAAADYLGHLYGGRIDPTGQQRVFTVAGGLTGLFRRAWNLNAILGGSPEKNRYDHRHHAIDAIVVALTEPSMIQRFAHEASRLLKAWPRVAVRLDPPWSTFLSDVQRHVEGIVVSFRVSRRLSGALHDQTYYAPPTEQGKTKVRKPLREMSSHEVERIVDPTVRDLVKEKLKQLGTSDPKKAFATDANLPIIRGKNNTALPVKSARIWVSSSVIAVGDGPRQRYVVPGNNHHIEIYALLDGQGQEVRWKGKIVSLYEAYERKKRGEPVVCRDHGPNTRFKFSLAKSEYIEWINDDGQKQLLRVVGISDDNLELRLPHDARPITLIREQRERIRATYRQLFQRRARKVMVTPLGEVLPAND

SEQ ID NO: 441 - protein, 1081 aa, Unknown
  Description of Unknown: uncultivated organism
  MG4-19 effector
MGETNTQTGSYILGIDLGSASLGWAAISLDGAGMATGLLRSGVRLFNPAVTGDIEKGQDESNAVARRTARLIRRQLRRRAARQSELFQLLQRYTLLPPYKGAEADASQQRHSILNALDQELTAKWVKPGNAGAQAAIELPLYLLRKTALDAALEPFELGRVFYHLSQRRGYRSNRKDQASDKGTPGKAKKADDLGAVQGGIKELEDAIRSSGTRTLGEYFTSLDPHSQKVRGRWTARRMYEEEFAAIWAKQVTFHPALLTEELHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIELARDLKKPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHRLTGALHDETNYGRPHKEGGKDVVHIRKQVVGMSAGDIENIVDPAVRESVREKAASFGGDLKKWTPKEGSEDWPLLRTKTGKEIPIKRVRIKKSLGVETIAKGDRARHVALSSNHHVAIFALLDERGGERRWEPMIVSLFEAMERKRKGQPLIQTRYPVVGEFIFKFSLMGGDTVLLHKDCDHKNNHCNPSVWRLRTIGSNGQLSLVRINDARLKAEIQKAKEWWSPTQDALRKLDAVKVVIDSLGRIHQSGG

SEQ ID NO: 442 - protein, 1081 aa, Unknown; identical to SEQ ID NO: 441
  Description of Unknown: uncultivated organism
  MG4-20 effector

SEQ ID NO: 443 - protein, 1081 aa, Unknown; identical to SEQ ID NO: 441
  Description of Unknown: uncultivated organism
  MG4-21 effector

SEQ ID NO: 444 - protein, 895 aa, Unknown
  Description of Unknown: uncultivated organism with predicted taxonomy: Planctomyces sp. SH-PL14
  MG4-22 effector
MGETNTQTGSYILGIDLGSASLGWAAISLDGAGMATGLLRSGVRLFNPAVTGDIEKGQDESNAVARRTARLIRRQLRRRAARQSELFQLLQRYTLLPPYKGAEADASQQRHSILNALDQELTAKWVKPGNAGAQAAIELPLYLLRKTALDAALEPFELGRVFYHLSQRRGYRSNRKDQASDKGTPGKAKKADDLGAVQGGIKELEDAIRSSGTRTLGEYFTSLDPHSQKVRGRWTARRMYEEEFAAIWAKQVTFHPALLTEELHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIELARDLKKPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGIVDSIRPHFEQMLVSHRPEHRLTGALHDETNYGRPHKEGGKDVVHIRKQVVGMSAGDIENIVDPTVRESVREKAASFGGDLKKWTPK

SEQ ID NO: 445 - protein, 1081 aa, Unknown
  Description of Unknown: uncultivated organism
  MG4-23 effector
MGETNTQTGSYILGIDLGSASLGWAAISLDGAGMATGLLRSGVRLFNPAVTGDIEKGQDESNAVARRTARLIRRQLRRRAARQSELFQLLQRYTLLPPYKGAEADASQQRHSILNALDQELTAKWVKPGNAGAQAAIELPLYLLRKTALDAALEPFELGRVFYHLSQRRGYRSNRKDQASDKGTPGKAKKADDLGAVQGGIKELEDAIRSSGTRTLGEYFTSLDPHSQKVRGRWTARRMYEEEFAAIWAKQVTFHPALLTEELHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIKLARDKKNPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHRLTGALHDETNYGRPHKEGGKDVVHIRKQVVGMSAGDIENIVDPAVRESVREKAASFGGDLKKWTPKEGSEDWPLLRTKTGKEIPIKRVRIKKSLGVETIAKGDRARHVALSSNHHVAIFALLDERGGERRWEPMIVSLFEAMERKRKGQPLIQTRYPVVGEFIFKFSLMGGDTVLLHKDCDHKNNHCNPSVWRLRTIGSNGQLSLVRINDARLKAEIQKAKEWWSPTQDALRKLDAVKVVIDSLGRIHQSGG

SEQ ID NO: 446 - protein, 1081 aa, Unknown; identical to SEQ ID NO: 441
  Description of Unknown: uncultivated organism
  MG4-24 effector

SEQ ID NO: 447 - protein, 1081 aa, Unknown; identical to SEQ ID NO: 441
  Description of Unknown: uncultivated organism
  MG4-25 effector

SEQ ID NO: 448 - protein, 1081 aa, Unknown; identical to SEQ ID NO: 441
  Description of Unknown: uncultivated organism
  MG4-26 effector

SEQ ID NO: 449 - protein, 1081 aa, Unknown; identical to SEQ ID NO: 441
  Description of Unknown: uncultivated organism
  MG4-27 effector

SEQ ID NO: 450 - protein, 1081 aa, Unknown; identical to SEQ ID NO: 441
  Description of Unknown: uncultivated organism
  MG4-28 effector

SEQ ID NO: 451 - protein, 1081 aa, Unknown; identical to SEQ ID NO: 441
  Description of Unknown: uncultivated organism
  MG4-29 effector

SEQ ID NO: 452 - protein, 770 aa, Unknown
  Description of Unknown: uncultivated organism with predicted taxonomy: Alphaproteobacteria bacterium
  MG4-30 effector
LNLERDYVFSIERGGEKTLKGNPTNADFRKALGERWDKMTPEERDRAVEYVHAFQRPDKIKVAAMKKWGLDEQSAEELAKISLEPDYLNLSRVAIEKLMPLLEGGFPYGALAPRYSAIGAEAVQKLLASAEAGTPFKETCETILGEPTVSSQEHDLLPPVGQALSEIRNPAVMRSLTELRKVVNGVLRHFGKPAQIRIELARELKKSKKQREAESKRNRENEAVRVKAKQTIKEITGDEHPSTDDVRRVQLFNDCRGTCVYCGETIAARNFLGRESQVDIDHIIPFSRSMDNSYANLVICHARCNRNKGDRTPFEAFSVDPESYGQIRDRVKIFAGDGRTVSEKIKRFEMDEGELEKFLGDFRNRQLNDTAYASRLAADYLGILYGGRTDREHRLRVQATAGQATARLRARWNLDSILDDGPTKHGGRASKERTDHRHHAIDAVVIGVTDQGMMERLSDAAKRGQEVGKRFARLDEPWNGFLEQVRKEVGQIVVSHRVSKKVSGALHEETIYSRPFPVGAGFKPAPTKAKPRCTDAEATEVRVRRGLSPSAKSTKQISAPEVEDIADPAVRKLVVAKLAELGGDLKKFADEKNLPFFETKDGRRIPIKRVRVSKALPTFTLGHGRSARHVASESNHHVEIYAELDQNGTEGEWDGEVISMYEAYQRLKAGRPVVQRDHGPLARFKFSLAPGEVVECDDKNGARSLFVMRKASQISSGQLQIGFAPPNDARKAREIQTSRAWLWANPNTLGDRNSRKVVVNPLGEVSESHE

SEQ ID NO: 453 - protein, 866 aa, Unknown
  Description of Unknown: uncultivated organism
  MG4-31 effector
DKEDDKNETEFKQDMAELSQLVKQHDPPYLGAYLACLNPDEQRLRGKRTSRQMYLDEFDAIWDEQSKHHGDLLTAEVQKTLHNTIFYQRPLKSQRHLRGKCSLTGKTRAPIALRIVQRFRAIQKLNDLQIVFADGTKRKLDEQERAKVFELQMTKGDVTFHSLKAKKVLGLPKDATFNLAEIDKKLIGHRTDAKLRKALGDRFDGLSEDQRDAIVQDIRSYRDTGPLAKRLKATYDLPSDIAADLSKVKLEKDRAAHATEAIRALLPLMERGIQYATARKQVYPESFASNTKTYDLLPSVNDWLKQHEKAVAIRNPAVMRGLTELRKVVNAIIRRYGKPKCIRIELARDLKNSRKKRADISKQNMERRGQREKAAELLAKQFGIEQPSHHDREKVLLHWECGGFCPYTGKPIELNDLFGPNPSFQVEHIWPLSASMDDSFMNKTLCHVDENARKGGRSPVDCYDQKTLDLIKERIGRFNCDWKVREAKRRRFTEPIPEDFHQRHLNDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQAKVAVDKIVVSYRPDRKLRGKLHQDTLYSEEIHGTRRIRRELHSLKPNEVEKIIDPRIRSVVSKKLAELKESNPAKAFADPTNLPTLTDHNGRTTRLRKARVRVSAKPTKIGKGASERSVNLGSNYHTVISQDERGRWCETTVSLIEAMRRKEDGEPVIQTPEGHTFLYSLVKNDHVEIPNGNGMGRIMRVESISQGFVEFGEHNDARTQAERGSERFYLRSGKKWTEVRPRKVAVTHLGEVKHAGG

SEQ ID NO: 454 - protein, 1036 aa, Unknown
  Description of Unknown: uncultivated organism
  MG4-32 effector
MASEFILGLDVGVASIGWAIIDWDGAPCGIRLAGTHLFEAGVDPGKSDPETAMLLGREQSRAKPRRDARAMRRQTWRRARRKKKVLGALIRADLLPPGDIRTPAAIDAYMKSLDASLRDRWESKGASHRDRQLLPYRLRAAAVTREVERHELGRGLYHLAQRRGFLSNRKAPDRADEDRSEMKKAIGDLATQIAAHDPPTLGAYLASLDPDDARLRGRWTSRQMYLDEFDRIWDTQAERIGLTQAQREEIHNAIFHQRPLKDQSHLVGRCSLVDGAKRCPIGERIAQRFRVLQQVNHLRVVLDDRTERPLTPGERQAMLDALLTKGDLKVAAARRAAGLPRSATLSIERGGEKRLVGHRTDAKLRKVFGDERWASMSEEEKDAAVHDLRSVRLPATLRRIGLTRWGLDTESAEEFAGLSLEEGHAAHSREALRRLVPRMEQDGLSYSEARKDEFPGSFESDEPHDLLPALDQWDRDLRNPSVARALTELRKLVNAIVRRYGKPVRIHIELARDLKSGRGRRERIANRMRDREKEREAAASAIAREIGVADPPRWMIEKHLLAEECGWRCPYTGKGFGIHDLLGRNSQFDLEHIWPFSRSLDNSYANKTICYHEENRNRKQGRTPAEAYSEEELQAILERVRAFKGDPFLIQAKLRRFTDPIEEGFTERHLQETRYIGRLACDYLGLLYGGQVEAQGTAVSERRILTPTGGLVAWLRRGWGLNSVLSDRDEKERNDHRHHAVDAIVIACADQRAIQRLSESAERMEREGRERPYESVDPPWEGFEQSVQEAIHAVVVSHRQSRKVRGPLHKETLYSKEHNGRRRVRKRVETLSKTDVEKGRIVDERALAAIRAKLDELGEPNPAKAFKDPANLPTVRGHDGRSVTLRKVRVEVGVQPRAFGKGAKRRYAQTARNHHMAFYKRSLPGGRMERTTKLVALADMVDRSSVVDREADDGFEFAFSLAPNEFVVIKDDQGDDRLCRVLSISADDLELVEHTDGRTSTDRKGERIRFRRRALSEDPIRKVHVNYLGEVHDAGG

SEQ ID NO: 455 - protein, 787 aa, Unknown
  Description of Unknown: uncultivated organism with predicted taxonomy: Insolitispirillum peregrinum
  MG4-33 effector
MLDYTLGLDLGAASVGWAVVKEPTTDQDTDSVLHLGVHRFEAGVADPGKMGHGGEESSAKPRRDARQMRRQLWRRKRRRRLLLARLQEHGLLPAGELDTPEAIHVYLRELDQAILDRNYPSATHEQQLKLPYLLRAKAVSERIEIDELGRVLYHLAHRRGFLSNRKTDKEDDKNETEFKQDMAELSQLVKQHDPPYLGAYLACLNPDEQRLRGKRTSRQMYLDEFDAIWDEQSKHHGDLLTAEVQKTLHNTIFYQRPLKSQRHLRGKCSLTGKTRAPIALRIVQRFRAIQKLNDLQIVFADGTKRKLDEQERAKVFELQMTKGDVTFHSLKAKKVLGLPKDATFNLAEIDKKLIGHRTDAKLRKALGDRFDGLSEDQRDAIVQDIRSYRDTGPLAKRLKATYDLPSDIAADLSKVKLEKDRAAHATEAIRALLPLMERGIQYATARKQVYPESFASNTKTYDLLPSVNDWLKQHEKAVAIRNPAVMRGLTELRKVVNAIIRRYGKPKCIRIELARDLKNSRKKRADISKQNMERRGQREKAAELLAKQFGIEQPSHHDREKVLLHWECGGFCPYTGKPIELNDLFGPNPSFQVEHIWPLSASMDDSFMNKTLCHVDENARKGGRSPVDCYDQKTLDLIKERIGRFNCDWKVREAKRRRFTEPIPEDFHQRHLNDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQA

SEQ ID NO: 456 - protein, 1066 aa, Unknown
  Description of Unknown: uncultivated organism with predicted taxonomy: Planctomycetes bacterium
  MG4-34 effector
MIAERRREREFILGLDLGVASIGWALLEVDESMRPTGVIRAGAHLFEAGVEGAIEQGRDESRAAPRRGARAMRKGHWRRQRRRRQVLLALQRHGLLPPGDVSTPSAVDRYIKSVDERLRETWCSNGDHRAQLVFPLQLRAAAATQDLGPHDIGRAIYHLAQRRGFLSNRRTEAVRGDEEDEGKVKSAIKDLAQAIDHSEQPTLGAYLATLDPDTERIRGRWTGRQMLLDEFETIWSRQAPKHEAMTDTAYEEIRHAIFHQRPLRKQQHLIGRCSLIPDKRRAPVAHRLYQRFRLLQKLNDLEILEPGRLQRPISAQERAIALALLEKNESVRFTTLRKKKGGLGLPKGTTFNFETDGESSLIGHRTDAKLRDVFGDDYDALSEREKDQIVEDLRSIREPAALKQRGVQRWGLAEEQAIRFASVRLEEGYGSHSLAAIRRLLPHMEEGARYAAARLAEFPESFTAVEPVDALAPVESALGKIRNPAVERALTELRKVVNAIIAEHGKPQLIRIELGRDLKRGRKEREKQSKRMAARRKQREEAKRRLLKETGIADPRRSDIERVLLADECNWICPFTGVKFGWSDLFGPTPRFDVEHIWPYSRSLDDSFLNKTICDQRENRTRKRNQTPHEAYGATPEVYERILQRVRAFSGDPWVLAAKLSRFEAESIPEGHVDRHLNDTRYMSRVACEYLGALYGGLSDEYHRRRVQSTTGGLTFELRRGWSLNSILGIGDEKNRADHRHHAVDAIVVALTGPKAIQQASRAAQRAETRGGARLFEEFEDPWPGFRDDVKAIVKSIVVSHRQSRKLSGALHAETNYSRPIHPAGAHHVRKELHKLTASDVDRIIDPRIRELVRQKLETIGEPNPKKAFAAPEHLPTITGSDGRTRTVRKARVRTGVKAKPIGKGVNRRYVAPTQGSNHHTVIVAHLNDAGEEVRWTDHPVTLLEAQQRKSNGEPVVQRDWGPGKRFKFSFASNEFIEMDADDGVRRIYRVLSLSEGNYELSEHIDGRKKTDRIQDQKRVKTEWERSKKVGTLIRERIVESAESMRRRKAGKISVSHLGEVRRAGG

SEQ ID NO: 457 - protein, 1036 aa, Unknown; identical to SEQ ID NO: 454
  Description of Unknown: uncultivated organism
  MG4-35 effector

SEQ ID NO: 458 - protein, 1053 aa, Unknown
  Description of Unknown: uncultivated organism with predicted taxonomy: Proteobacteria
  MG4-36 effector
MTYVLGLDIGARSVGWALLEKEGDTFTRIVRAGVRVFEAGTEGDIERGRDESRGATRRLKRLARRQIRRRRQRARALYRELANAGLLPAIKPSPGSPMALLIQDEINRLDHELRERYAGERAVSQLPYLLRARALDHRLEPYELGRAVYHLGQRRGFRSNRKAESGKKATEDPSKAKEEKSLVYRGIDDLKEQIRQAGARTLGEYFATLDPAEQRIRNRYTHRSMYEEEFEAIWEAQRPHHAALTRELKDRLREILFGQRPLRDTEDLVGECEWIPGEKRAPVWSLEYQRFRLLQTVNHLRVTENRSSPRPLTPEERQCLLEELEKKPKVTIAQAKRVLGLQRAEFTIEEGGQKDLPGDKVASQFHEILGQRWLELRPEQQRALVECVASAGSDEQLLEDLKQQWRLSDDQATQIVRNVHLPSGYASLSLKAIQKVMPYLEQGMDVQRARLEARIPLDRPVPVRELLPPLADSGVAVFNPAVKRALTEMRKVVNAVIRRYGKPDEIHLETARELRKSREERMNESKRMRGREKEREEILRRIRDEVGIPEEKISRDDVLKGLLWQECDGKCPYCGESLGGFASLYGGNSPAQIEHIIPFSRSLDNSFVNLTLAHVSDNNYKGDRTPWEAYGSNPERWDQILQRVSVFRGSYSKAKLNRFKMDENAVRELSEQFSSRALNDTRAASVAAARYLALLYGGEIVDGKRKILKITGQVTAYLRDVWGLNGLIPSIHREARGEAADAEAESRTLKSRDDHRHHAVDAVVVALCNQRWIQRLSEANRGALAARRRWFAPVEPPWVGFKEQLKDTLKSMNISFRPDHRVTGALHKETFYTRIGQNEKGGDVVRVRMPVTNLGSKEVEAIADPAVRQIVQAELKEVGGDARKLENNWPLLPNRHGKPVPIRKVRVNLNRAVVSVGKGPWQRWAEPSETHHIEIYEVEENGRRVWRGDVVSMREAIERATRGEPVTRRRGGAGVRYLFSVSKEDTLRLHGKYEGLWVVKKIAQKGQITLVSQFDARSEQNRTVFSPRVGGLQGYSAEKVVVLPIGDVVPCNE

SEQ ID NO: 459 - protein, 754 aa, Unknown
  Description of Unknown: uncultivated organism with predicted taxonomy: Solemya velesiana gill symbiont
  MG4-37 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQRPLRDTEDLVGECAWIPREKRAPVWSLDYQRYRVLQTVNHLRVAENRCAPRPLTHEERWRLLEELEKKPKVTVAQAKRVLGLQKAEFTVEEGGEKELPGDKVAAQFYEKLGESWSRLNPEERRALVECVATAESDEQLSETLQQQWGLSADQANKVVREVHLPSGYAPLSLKAIRAVMPYLEQGMDVQRARLAAGIPLDRPVPVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWNEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDD

SEQ ID NO: 460 - protein, 1032 aa, Unknown
  Description of Unknown: uncultivated organism with predicted taxonomy: Acidobacteria
  MG4-38 effector
VDYVLGLDLGARSVGWALIELQGDEPKRVVAAGVRVFEAGAEGNIEEGREESRGVKRRQARLARRQTRRRRQRLRQLYRELAGAGLLPAVQASPGRPFAVAVQEAINVLDGQCRLQYQHDPCANRIPYLLRARALDEPLAPWELGRVFYHIGQRRGFKSNRKAEARDPEERSLVYDGIRRLEEEIQRTGARTLGEYLSKLDPRQERIRCRYTQRSMYEREFDAIWAAQSPHHPCLTTELRERLAAVLFSQRPLKDGAELVGSCSWDPSQKRAPAWSLEYQRFRVLQEVAHLRYADESQVWQPLDAEQRSKLVAALSTTRELDFRAIRKLLGFAGKVRFSVEAGGEKKLRGNVVAAEFIRAIGEEWNALGAERQAELVRQVALAEDDDKLREELITNWRLTPEQAGRLVADVRLPRGYAALSLKAIRAALPYLEQGMSVQQAREAAGYELMPPVPARDLLPPLASSGIEVFNPAVKRSLTELRKVVNAVVRKYGKPAEIHIEVARELRKSREERQKESRRMREREAERERMRQKIHKEVGIPLEQIREEDVRKGLLYEECCRTCPYTGKPLGGFAGLFSGTSPVQIEHIIPYSISLDDSFANLTLCLASENAVKHNRTPYQAYSADPGRWEDIQARVRAFRGPYAAEKLRRFLMDEQAAAALLQRFSARHLNDTRYAAVVAGRYLSLLYGGEVIDGKRKILKVTGQITAHLRRVWGMNEILGRAGVKSRDDHRQHAIDAALVAVADQRSVQRLSQAAARAELQHRRRLPALEPPFVGFKEGLQCLVQTMNISFRPDHRVSGPLHKETFYAVSGAPAAPTGTIRTRKPVFRLTEEDVDRIADPAVRCLVKQKLAGVGEARKLEKDWPVLPNAHGQPVPIKRVRLELRDAVRAVGQGHRRRWAEVGESHHVAVFEVTKRSRQGTRTAWEGEVVSLWEALERLRLGKPVIDRAGGPDRRFLFSLCKNDTLQLNGPRPGIYVVRKIRQNKQITLVPQHDARPEKQREQFSPTVSGLLEYAARKVVVTPLGELVESHE

SEQ ID NO: 461 - protein, 784 aa, Unknown
  Description of Unknown: uncultivated organism with predicted taxonomy: Planctomycetes
  MG4-39 effector
VLQPMRVPYVLGLDIGVQSVGWALAQLDEEGNPCGILRLGVRSFESSSGSEQEIEKGTDEPASRQRREKRLMRRQLFRRQQRLRRTARVLQQAGLLPQFSLEPASRDAAITQLDAQLRSQFIGSGNHVDAQLLPYRIRAAALDEVLPAYALGRAFYHLAQRRGFLSNKKASAKKDDEDKGKVKAGIAELTRQIEVAGARTLGEFFARLDPHQQRIRSRWTSRKMYQQEFDAIWEAQAPHHPQTLTAELKARLYRAIFFQRPLKSQKGLIGRCSLEKGRRRAPLACLEAQRLRYWQKLNDLRLKDARRILNAIPEAERLIDWLPQEGQGRLTLYAKQLLAQEFETNEELTFNRIRQILGLKKKKDSDLDFTFNLEEGDEKKLPGNRTAAKLLKALGQRWQDMPEDQRQRLVDEILSFEKEEPLARRLEKAWGFSPSEAANVAAIDFEQGYHSFSRQAIRKILPHLQQGQALATIIKQLYKDTQPQATVWDRLPPLRDVFPQVNNPVVRRALTEVRKVVNAILRVYGKPQRVHIELARDLKKSRHERQQLSKGMRQQQKQREDARNWLQHEMGISNPTAHDILKYRLWIECEKLCPYTGKPISKEALFGSEPQFDVEHIIPYSRCLDNSFANKTLCEVAENRAAKKNRTPYEAYGNAPQRWHEILQRVSRFRGDAAKAKLRRFQLTEIPADFANRHLNDTRYSSRLASEYLSLLYGGRSDAQGNLRVQASTGAVTSLLRDQWGLNAILAELGRQLGVSGLDDDVEKARFDHRHHAVDALVIALTTP

SEQ ID NO: 462 - protein, 1106 aa, Unknown
  Description of Unknown: uncultivated organism with predicted taxonomy: Thermogutta terrifontis
  MG4-40 effector
VDHLEVHVSDSAGGHVSEIPEYLLGIDLGVLSLGWAAVKLQDGRPIGLLDAGVRAWDLQNIAESDIAVGKEEPPSQTRRQMRQMRRQLFRRAQRLRRTWRALQQLGLFPPGSRHCAARKAFLDQLDGQAKAWLCQHRFGSADPPPHWEDTWIYHLRAAALDQPLPPELLGRVFFHLAQRRGFQSTAKTRSAGDQKDGEDRKNKKNKKGKKSEKSERERIRAAISQLQQAMQTSGARTLGEYFARLDPHQERIRGRWTSRRMYKEEFEAIWTAQAPFHPEWTAADKDRLFRALFFQRPLKSQRGLVGLCPLESKVLPPAQPGQKAKVLYRHRRAPLASLEAQRIRYMQRINDLEIIAPDGTHWVLRDPAYQLMRSKLYDLAEHHEELTFPAIRKALGIPTGKKGEDWKFNLEAGGEKKLPGNTTAARIRRILGDQRWDSLGPDGQKQLVDTLLAFLSEEALQQHLEAHWHLDPPTAQALAHLELEPGYHSYSRRAIRKLLPLLEQGLRLNEARRKLYPQKEADAGGWDRLPPVCQVLPQVRNPLLVRALTELRKVVNALLHKYGKPVQIRIELARDIKRSRREREALSRRMRKQEDSRKKAAQIAREHLGREPSPFEITKVLLAEECNWKCPYTGREKIELAALLGPEPQFDVEHIWPFDRSLDDSFANKTLCYHEENRLRKSNRTPWEAYGSDPHRWGEIIARVKQFKGEWAKEKLRRFLAQELPEDFPQRHLSDTRWISRTAADYLGLLYGGRIDPTGKQRIQTTAGRLTALLRRAWDLDSILGPGTEKNRADHRQHAIDAVVIALTDPAVVHRLSRWASHRPSWVRITPQLDSPWPGFFDQVKHRILSILVSFRQHRRLSGPLHDQTFYAPPVPSPEDPKKLRTKVRKKLSELSDNAVEDIVDPEVRRLVQEKLRALSEHDPKKAFASPENLPYLRSRRTGQIIPIKSVRIWVTAHLEKIGSGMRQRYVIPGTNHHLEIFAHLDAQGNETRWDGHVVSLLEAVRRKRLGQPVVCRDHGPNTRFKFTLAKGDYIQWTDDQGQPQILRVIGISHNNIEFRLPSDARPITIIKQEKQRIRARYQTLFQRRARKVAVSPLGEVYPAGD

SEQ ID NO: 463 - protein, 811 aa, Unknown
  Description of Unknown: uncultivated organism with predicted taxonomy: Planctomycetes
  MG4-41 effector
VLQPMRVPYVLGLDIGVQSVGWALAQLDEEGNPCGILRLGVRSFESSSGSEQEIEKGTDEPASRQRREKRLMRRQLFRRQQRLRRTARVLQQAGLLPQFSLEPASRDAAITQLDAQLRSQFIGSGNHVDAQLLPYRIRAAALDRPLPVYALGRAFYHLAQRRGFLSNKKASAKKDDEDKGKVKAGIAELTRQIEAADARTLGEFFARLDPHQQRIRSRWTSRKMYQQEFDAIWEAQAPHHPQTLTAELKARLYRAIFFQRPLKSQKGLIGRCSLEKGRRRAPLACLEAQRLRYWQKLNDLRLKDARRILNAIPEAERLIDWLPQEGQGRLTLYAKQLLAQEFETNEELTFNRIRQILGLKKKKDSDLDFTFNLEEGDEKKLPGNRTAAKLLKALGQRWQDMPEDQRQRLVDEILSFEKEEPLARRLEKAWGFSPSEAANVAAIDFEQGYHSFSRQAIRKILPHLQQGQALATIIKQLYKDTQPQATVWDRLPPLRDVFPQVNNPVVRRALTEVRKVVNAILRVYGKPQRVHIELARDLKKSRHERQQLSKGMRQQQKQREDARNWLQHEMGISNPTAHDILKYRLWIECEKLCPYTGKPISKEALFGSEPQFDMEHIIPHSRCLDDSFANKTLCELAENRAAKKNRTPYEAYGHDPQRWHEILQRVSRFQGDAAKAKLRRFQLTEIPADFANRHLNDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPP

SEQ ID NO: 464 - protein, 1111 aa, Unknown
  Description of Unknown: uncultivated organism with predicted taxonomy: Thermogutta terrifontis
  MG4-42 effector
VDHLEVHVSDSAGGHVSEIPEYLLGIDLGVLSLGWAAVKLQDGRPIGLLDAGVRAWDLQNIAESDIAVGKEEPPSQTRRQMRQMRRQLFRRAQRLRRTWRALQQLGLFPPGSRHCAARKAFLDQLDGQAKAWLCQHRFGSADPPPHWEDTWIYHLRAAALDQPLPPELLGRVFFHLAQRRGFQSTAKTRSGGEQKDGEDRKNKKNKKGKKSEKSERERIRAAISQLQQAMQTSGARTLGEYFARLDPHQERIRGRWTSRRIYKEEFEAIWAAQAPFHPEWTAADKDRLFRALFFQRPLKSQRGLVGLCPLESKVLPPAQPGQKAKVLYRHRRAPLASLEAQRIRYMQRINDLEIIAPDGTHWVLRDPAYQLMRSKLYDLAEHHEELTFPAIRKALGIPTGKKGEDWKFNLEAGGEKKLPGNTTAARIRRILGDQRWDSLGPDGQKQLVDTLLAFLSEEALQQHLEAHWHLDPPTAQALAHLELEPGYHSYSRRAIRKLLPLLEQGLRLNEARRKLYPQKEADAGGWDRLPPVCQVLPQVRNPLLVRALTELRKVVNALLHKYGKPVQIRIELARDIKRSRREREALSRRMRKQEDSRKKAAQIAREHLGREPSPFEITKVLLAEECNWKCPYTGREKIELAALLGPEPQFDVEHIWPFDRSLDDSFANKTLCYHEENRLRKSNRTPWEAYGSDPHRWGEIIARVKQFKGEWAKEKLRRFLAQELPEDFPQRHLSDTRWISRTAADYLGLLYGGRIDPTGKQRIQTTAGRLTALLRRAWDLDSILGPGTEKNRADHRQHAIDAVVIALTDPAVVHRLSRWASHRPSWVRITPQLDSPWPGFFDQVKHRILSILVSFRQHRRLSGPLHDQTFYAPPVPSPEDPKKLRTKVRKKLSELSDNAVEDIVDPEVRRLVQEKLQALSQHDPKLADPKKAFASPENLPYLRSRRTGQIIPIKSVRIWVTAHLEKIGSGMRQRYVIPGTNHHLEIFAHLDAQGNETRWDGHVVSLLEAVRRKRLGQPVVCRDHGPNTRFKFTLAKGDYIQWTDDQGQPQILRVIGISHNNIEFRLPSDARPITIIKQEKQRIRARYQTLFQRRARKVAVSPLGEVYPAGD

SEQ ID NO: 465 - protein, 1111 aa, Unknown; identical to SEQ ID NO: 464
  Description of Unknown: uncultivated organism
  MG4-43 effector

SEQ ID NO: 466 - protein, 1056 aa, Unknown
  Description of Unknown: uncultivated organism with predicted taxonomy: Proteobacteria
  MG4-44 effector
MSGENIETILGLDLGANSVGWALIECVDGKARRILGMGSRIFEAAIEGDLEKGQEEPRAVERRMARQMRRQHKRRVMRMIRVGELLQQAGWFPPGNLRDSVERDRILKELDKSLRQQYADRGFHLSGIDAIRGIAYFLRARALDEPLEPYALGRAIYHLAMRRGFLSNRKAPMKKDEELGAVKKGISDLESEMKQCQARTLGEYFYKVDPVHEKRIRKRWTARQMYKDEFDTILQQQVKLGAIRDDPKFFRKLRKAIFRQRPLKSQCGLIGPCQFEKNEKRAPWHNLLAQEFRLLQKINDLRLIDPSTREERPLNAEERKILYDWLMEHGEATFAELRKKLGFNPRDGQKFNLEAGDETRLKGNEVAARLIAVLGEERWRGITDQEKAQLISELNSDITEERLRYRAEKVWGITDPERVDKLVKLTLPKGYCSLSKIALKKLVPLMREGKDYVTAAREVYGDLQYKNQTFDRLPPFLKVDRTLRSPVVIRTLSETRKVVNEILRVFGRPNRIHIELAREMKQSRIQRQKRYQTMRDREKMRNQARQSLQAELGWDPNDIKGRDIEKWLLAEECSWVCPYSGKPINYHNLFGEKAEFDIEHIIPYSKSLDDSFVNKTLCHREWNQKKGNRTPAQAFKNTPEWEAMLQRVRAFKPLHAVHMKKGESSKRNPKYDLFCMEEIPPDYVDNKLNDTRHAAKVAMGYLGLLYPKEERLKRVKAFAGGVTGELRKCWKLNSILGDPDSVEPKKNRADHRHHAIDALVLALATPGMVQYLSKAAAQQLACQRSIRGYQKFMEDPWPHFLEDVRKAVNAIVVSHRVDHRLQGRLHNDTLYSPPRVDENGKTYHVVRKPLDGNFKKVGDIEDPEVRRIVQEHLADHDGDPKKAFNDPDNHPKINDIPIHAVRVRDYVKPEKIGKDFCPRYALTDSNHHMEIIEEKDKKGNPRWTAIVVSRFEAMQRKIRGEPIVQREHGEGRRFVCSIASGDTFSYREKEDGPGIFARVRSIWKQNVEFVQINDARLKAEIKKENEWYVRSVNELRKMGFQKVSVSPIGEVYPAND

SEQ ID NO: 467 - protein, 1056 aa, Unknown; identical to SEQ ID NO: 466
  Description of Unknown: uncultivated organism
  MG4-45 effector

SEQ ID NO: 468 - protein, 1111 aa, Unknown; identical to SEQ ID NO: 464
  Description of Unknown: uncultivated organism
  MG4-46 effector

SEQ ID NO: 469 - protein, 1056 aa, Unknown
  Description of Unknown: uncultivated organism with predicted taxonomy: Proteobacteria
  MG4-47 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQRPLRDTEDLVGECAWIPDEKRAPVWSLDYQRYRVLQTVNHLRVAENRSAPRPLTHEERWRLLEELEKKPKVTIAQAKKLLGLKKAEFTVEEGGEKELPGDKVAAQFYEKLGESWSRLNPEERRALVECVATAESDEQLSETLQQQWGLSADQANKVVREVHLPSGYAPLSLKAIRAVMPYLEQGMDVQRARLAAGIPLDRPVTVHPLLPPVADSGVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDRQAEARPVKSRDDHRHHAVDAVVVALCNQGWIQRLSEANRGALAARRRLFAPVEPPWVGFKEQLKDILKSMNISFRPDHRVTGALHKESHYGYSKVSESDNPVFKIRKPVYELTKSMVQKIVDPAVRSAVQEKLAAVGGKVEALKGNWPVLQSKNGQSRPIKKVRIQVALSPIEVGKNHRKRFVEVEDTHHMEVFEVPGRLSKWKARVVKMHEAAARLVCGANIFDRHLDSKSRYLFSLMKGDCLQMHGEMSGIWIIKTIRANTQIELVSQYDARPVGSSKGGARVTRKCISEFQKFSPRKVVVLPIGDVVRCNE

SEQ ID NO: 470 - protein, 1026 aa, Unknown
  Description of Unknown: uncultivated organism
  MG4-48 effector
VRQDEHGTVHIVDSGVRVFPWTIEEDTLKSRNIERRTARHRRRQLERRARRRRVLARLLHHYGFLPPWPADWRTFDFHRDPAWGPLLAKDPYELRAKALDQLLEPWEFGQVIYHLAHRRGFAGFRKVRDDEELGNIRREIEQLDQEIKRSGARTLGEYLAQLDPRERRRRGRHTSRDWYRAEFELIVATQQRLGLPLTPDMVRTLRRAIFHPRPLKVVPSAIGRCPLVRGRRRAPQGLREAQEFRYLQNLANLRIILPNGVQRGLTPPERKTVIQHLEQVEEMTFNELRKLLFADRVESARSRSQTAPERSHTPAAVTADGRTPAAMPVDTTVPSTMEQWNPGWKLQDIRFNLEEGEREEIEGNVTAARIRKAIGAKWDPATPDIRRAMVEMWIGIEDEDVCKQVALRQTEWGLTESEAEALSQVAFEGGRCRFSSTALRRLLPHLRQGRSLYDAIQQEFPEHGEQVALDEVPPLGEEIPNPLVRRALSETRRIVNAILTTYGKPSEIHIELARDLRRPLCEVREMIKQMRKREKMRREAERKLCEEHGIRKPTAREIEKYLLWKECNARCPYTNQDIRAEALFGSHPRFDVEHIIPWSRCLDDSFANKTLCEAKHNREQKRNRMPTEAYSREALEQIWERVRRFQGDYAAEKLRRFQMDPPPELHLIHRGDQLHATAYAARVAARELARLYPNQERAHRIWVSSGRATACLRDAWQLNQLLGRKDEKNRADHRHHMVDAVVVALTTPKIVQDLTHAAQNAVRARRFQGMEPPSGLHEALRQRLEKVIVSHRVERKVQGPLHEETFYGLIRSPETGEIRPVVRKRIDTLTLNEVKNIVDPNIRQIVLERCGEKDPKTVFKDPQQIPWLDFGSKRVRLRRVRIYVNQEPIEIGQNPPRRCFTGSNHHLEIFDCRGQWRCEVVSRWEAMRRLRAGEPVVRRQDAHGCPLVFSLARGDTVELKWKSGTLIAVVQKFSERDYTFRAHDDGRMDKEIREDRIRIRSDRRLQEVLVRKLSVDVLGRAYVSRE

SEQ ID NO: 471 - protein, 1088 aa, Unknown
  Description of Unknown: uncultivated organism
  MG4-49 effector
VLQPMRVPYVLGLDIGVQSVGWALAQLDEEGNPCGILRLGVRSFESSSGSEQEIEKGTDEPASRQRREKRLMRRQLFRRQQRLRRTARVLQQAGLLPQFSLEPASRDAAITQLDAQLRSQFIGSGNHVDAQLLPYRIRAAALDEVLPAYALGRAFYHLAQRRGFLSNKKASAKKDDEDKGKVKAGIAELTRQIEAADARTLGEFFARLDPHQQRIRSRWTSRKMYQQEFDAIWEAQAPHHPQTLTAELKARLYRAIFFQRPLKSQKGLIGRCSLEKGRRRAPLACLEAQRLRYWQKLNDLRLKDARRILNAIPEAERLIDWLPQEGQGRLTLYAKQLLAQEFETNEELTFNRIRQILGLKKKKDSDLDFTFNLEEGDEKKLPGNRTAAKLLKALGQRWQDMPEDQRQRLVDEILSFEKEEPLARRLEKAWGFSPSEAANVAAIDFEQGYHSFSRQAIRKILPHLQQGQALATIIKQLYKDTQPQATVWDRLPPLRDVFPQVNNPVVRRALTEVRKVVNAILRVYGKPQRVHIELARDLKKSRHERQQLSKGMRQQQKQREDARNWLQHEMGISNPTAHDILKYRLWIECEKLCPYTGKPISKEALFGSEPQFDMEHIIPHSRCLDDSFANKTLCELAENRAAKKNRTPYEAYGHDPQRWHEILQRVSRFQGDAAKAKLRRFQLTEIPADFANRHLNDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPPWGTRAQFVADVRNAVLAINVSRRVDRRLKGPLHEETIYGKPKQCVDEKGKTIQVAHVRKPLESLSPNNVDHIVDPVIRELVKKKLQELGTTDPKKAFQAKDNHPYMKARDGRIIPIHKVRIRVPTETLMAIGHGPTLRHVKPGVNHHMEIVATLDAAGNEIRWEGITVSLFEALQRLRNKQPVVQRDHGPGKRFKFSLSGGEYLEFVENGRNKLVRVSVISGDDVEFRLHNDARPNTMLRGVKGARAGLVRSADALRKLKARKVLVDPLGNILPAND

SEQ ID NO: 472 - protein, 770 aa, Unknown
  Description of Unknown: uncultivated organism with predicted taxonomy: Solemya velesiana gill symbiont
  MG4-51 effector
MALVLGLDLGARSVGWALLEKQGDNWTRIVRAGVRVFEAGTEGNIEQGRDQSRGATRRIARLARRQIRRRRQRARALYRELASAGLLPEVTPSPGSPLAVLIQQAINDLDEHLRQKYAQESAVSQLPYFLRARALDHRLEPHELGRVIYHLGQRRGFKSNRKAEAREKADGDPLKEQKDKSVVYREIEELKAQIQDTGARTLGEYLSRVDPAVERIRHRYTQRRMYEEEFEAIWEAQRPHHAALTRDLKDRLWDILFKQRPLRATDDLVGECDWIPGEKRAPVWSMDYQRFRLLQAVNHLRVSENHSAPRPLSSEERLRLLDVLETQSKISFAQAKKILGLRKAEFTIEEGGETNLPGNAVAAQFYEKLGQDWIRLKPEDRQALVECVAVAESDEQLLEALKQQWGLSEDQARRIVQEVSLPSGYARLSLKAIRAVMPYLEEGWDVQRARIEAGIPLHRPVELHDLLPPLADSGVAVYNPAVKRVLTEMRKVVNAIITHYGKPDEIHLETARELRKSREEREKDSKRMREHEKEREAIIRRICEEIGIPETGISRDDVRKAMLWEECNGMCPYSGRSLGGFASLFSGNSPAQIEHIIPFSRSLDNSFVNLTLAHVSENAYKGDKTPWEAYGSNPEQWDRILQRVALFKGSYKKAKLNRFKMDSNAVGEFLEQFSSRALNDTRAAAVAAARYLALLFGGETVGGKLKILKITGQVTAHLRDAWDLNGLIPSIHRETRGEAADKEPKTPPLKSRDDHRHHAVDAVVVALCDQ

SEQ ID NO: 473 - protein, 1053 aa, Unknown
  Description of Unknown: uncultivated organism
  MG4-52 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQCPLRDTEDLVGECAWIPGEKRAPVWSLDYQRYRVLQTVNHLRVAENRSAPRPLTHEERWRLLEELEKKPKVTIAQAKKLLGLKKAEFTIEEGGEKELPGDKVAAQFYEKLGESWSRLNPEERRALVECVATAETDEQLSETLQQQWGLSADQANKVVREVHLPSGYAPLSLKAIRAVMPYLEQGMDVQRARLAAGIPLDHPVSVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQWVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHRVTGALHKETFYTRIGKNEKGGDVVRVRVPVTGLGSKDVEAIADPAVRAIVRAKLEEVGGNAKKLENNWPLLPNRNGKPVPIKKVRVNLNRAVVSVGKGRWQRWAEPSETHHIEIYEVDEKGKKVWRGDVVSMREATERAARGTPITHRRGGVNTRYLFSVSKEDTLRLHGEHEGLWVVKKIAQKGQITLVSQYDARPEQGRTVFSPRLGGLQVHSAEKVVVLPIGDVVRCNE

SEQ ID NO: 474 - protein, 1055 aa, Unknown
  Description of Unknown: uncultivated organism
  MG4-53 effector
MSSYILGLDVGANSIGWAVVPLQNGAPAGVTRAGVRVFAAAVANLEEAQPETANAQRRLARLTRRRLDRLARRLEHLFRLLQRHGLLPPDPAPSPPASRLEAAHRRHDLLRRLDADLLSEWAARGARGEVPLPDPATLPHVLPYLLRARALDEKLSPYALGRALYHLGQRRGFLSNRRAGAKEEEGEVKKGIDSLAAEMAAAGARTLGEYFSRLDPQSARIRGRYTSRRMHEDEFALIWAAQCVHYPDRLTDDLKKQVHHAIFYQRPLRFRKDAIGPCQFELNRRRAPMALLACQRFRLLQSVNHLQVLLPDGRPRPLAESERQALIAALEEQGDLKFAQVRKLLALPRDTAFNLERGGEKKLPGNRTAAALRAVFGAARWAQLTPADRDRLVDDLRSIQQDEALVRRAMRVWGLDAAAAQQLAAVRLEQGYLNLSRQAVAKLLPLLEAGKPYATAVAEVYGPRPAPPPVDQLPLVSAALPHLTNPVVQRALTEVRRVVNALIRQYGKPECIRVELAREVKKNARQRHQIALRNRENERLRRAAAERIVREVGIANPSRADIEKVLLAEECNWHCPYTGKPISMAALFGEHPQFDVEHIIPFARSLDDSFMNKTLCDAEENRRVKRGRTPFEAYGSQPERWAEILRRVRAFKGSAADAKLERFRCESPPDATELCSRLLNDTRYAARAAAEYLGRLYGGQSDAGHRRRIQVATGQVTAFLRREWGLNAILGDGDEKSRDDHRHHAVDALCVALTDAGIVQALAAAAARAPAEGRRCFARLAPPWPSFLADARRAVLEITVSHRVRRKVSGPLHAESFYSRPHRDPQGRECRHIRKPVEALSPDEVAAIVDDKVRECVRAALRAKNLDPDAIRNSRAIAQAFASPADHPCLVARDGRRIPIHRVRIRKVVNAFTLGDRHVVTETNHHVEIFARLNPDGEVARWEGKVVTLLEAVQRLRAGLPIVNRDHGPDTRFLFSLALREAVRMDDGQGGRMLCVVVVVSQTQQGRIDLEFRRHHDARPGMQGERIRKTPNSLRLAHAEKVVVDPLGRVWPAHD

SEQ ID NO: 475 - protein, 813 aa, Unknown
  Description of Unknown: uncultivated organism
  MG4-54 effector
EFDAIWAAQSPHHPCLTTELRERLAAVLFSQRPLKDGAELVGSCSWDPSQKRAPAWSLEYQRFRVLQEVAHLRYADESQVWQPLDAEQRSKLVAALSTTRELDFRAIRKLLGFAGKVRFSVEAGGEKKLRGNVVAAEFIRAIGEEWNALGAERQAELVRQVALAEDDDKLREELITNWRLTPEQAGRLVADVRLPRGYAALSLKAIRAALPYLEQGMSVQQAREAAGYELMPPVPARDLLPPLASSGIEVFNPAVKRSLTELRKVVNAVVRKYGKPAEIHIEVARELRKSREERQKESRRMREREAERERMRQKIHKEVGIPLEQIREEDVRKGLLYEECCRTCPYTGKPLGGFAGLFSGTSPVQIEHIIPYSISLDDSFANLTLCLASENAVKHNRTPYQAYSADPGRWEDIQARVRAFRGPYAAEKLRRFLMDEQAAAALLQRFSARHLNDTRYAAVVAGRYLSLLYGGEVIDGKRKILKVTGQITAHLRRVWGMNEILGRAGVKSRDDHRQHAIDAALVAVADQRSVQRLSQAAARAELQHRRRLPALEPPFVGFKEGLQCLVQTMNISFRPDHRVSGPLHKETFYAVSGAPAAPTGTIRTRKPVFRLTEEDVDRIADPAVRCLVKQKLAGVGEARKLEKDWPVLPNAHGQPVPIKRVRLELRDAVRAVGQGHRRRWAEVGESHHVAVFEVTKRSRQGTRTAWEGEVVSLWEALERLRLGKPVIDRAGGPDRRFLFSLCKNDTLQLNGPRPGIYVVRKIRQNKQITLVPQHDARPEKQREQFSPTVSGLLEYAARKVVVTPLGELVESHE

SEQ ID NO: 476 - protein, 950 aa, Unknown
  Description of Unknown: uncultivated organism with predicted taxonomy: Flavobacterium hercynium
  MG4-55 effector
LKELDKSLRQQYADRGFHLSGIDAIRGIAYFLRARALDEPLEPYALGRAIYHLAMRRGFLSNRKAPMKKDEELGAVKQGISELEREMKQCQARTLGEYFYKVDPVYEKRIRKRWTARQMYKDEFDTILQQQVKLGAIRDDPKFFRKLRKAIFRQRPLKSQCGLIGPCQFEKNEKRAPWHNLLAQEFRLLQKINDLRLIDPSTREERPLNAEERKILYDWLMEHGEATFAELRKKLGFNPRDGQKFNLEAGDETRLKGNEVAARLIAVLGEERWRGITDQKKAQLISELNSDITEERLRYRAKKVWGITDPERVDKLVKLTLPKGYCSLSKKALKKLVPLMREGKDYVTAAREVYGDLQYKNQTFDRLPPFLKVDRTLRSPVVIRTLSETRKVVNEILRVFGRPDRIHIELAREMKQSRIQRQKRYQTMRDREKMRNQARQSLQAELGWDPNDIKGRDIEKWLLAEECGWVCPYSGKPINYHNLFGEKAEFDIEHIIPYSKSLDDSFVNKTLCHREWNQKKGNRTPAQAFKNTPEWETMLQRVRAFKPLHAVHMKKGESSKHNPKYDLFCMEEIPPDYVDNKLNDTRHAAKVAMGYLGLLYPKEERLKRVKAFAGGVTGELRKCWKLNSILGDPDSVEPKKNRADHRHHAIDALVLALATPGMVQYLSKAAEQQLACQRSIRGYQKFMEDPWPHFLEDVRKAVNAIVVSHRVDHRLQGRLHNDTLYSPPRVDENGKTYHVVRKPLDGNFKKVGDIEDPEVRRIVQEHLAAHDGDPKKAFNDPDKHPKINDIPIHAVRVRDYVKPEKIGKDFCPRYALTDSNHHMEIIEEKDKKGNPRWTAVVVSRFEAMQRKIRGEPIIQRNHGEGKIFVCSIATGDMALVDLEPTNPNVLVRVRGISFNEVSLVRANDARQKKEIVSSGDFIRKTPLMLQKMNFRKVSVSPIGEVYPAND

SEQ ID NO: 477 - protein, 878 aa, Unknown
  Description of Unknown: uncultivated organism with predicted taxonomy: Pseudoxanthobacter soli
  MG4-56 effector
SGAGLLPPITPVPGSPMAVLIQEAINRLDCELRRKYAGERAVSQMPYLLRARALDHRLEPYELGRAVYHLGQRRGFRSNRKAESGKKATEDPSKAKEEKSLVYRGIDDLKEQIRQAGARTLGEYFATLDPAEQRIRNRYTHRSMYEEEFEAIWEAQRPHHAALTRELKDRLREILFGQRPLRDTEDLVGECEWIPGEKRAPVWSLEYQRSRLLQTVNHLRVAENRCAPRPLTPEERQCLLEELEKKPKVTIAQAKRVLGLQRAEFTIEEGGQKDLPGDKVASQFHEILGQRWLELRPEQQRALVECVASAGSDEQLLEDLKQQWRLSDDQATQIVRNVHLPSGYASLSLKAIQKVMPYLEQGMDVQRARLEARIPLDRPVRVRELLPPLADSGVAVFNPAVKRALTEMRKVVNAVIRRYGKPDEIHLETARELRKSREERMNESKRMRGREKEREEILRRIRDEVGIPEEKISRDDVLKGLLWQECDGKCPYCGESLGGFASLYGGNSPAQIEHIIPFSRSLDNSFVNLTLAHVSDNNYKGDRTPWEAYGSNPERWDQILQRVSVFRGSYSKAKLNRFKMDENAVRELSEQFSSRALNDTRAASVAAARYLALLYGGEIVDGKRKILKITGQVTAYLRDVWGLNGLIPSIHREARGEAADAEAESRTLKSRDDHRHHAVDAVVVALCNQRWIQRLSEANRGALAARRRWFAPVEPPWVGFKEQLKDTLKSMNISFRPDHRVTGALHKETFYTRIGQNEKGGDVVRVRMPVTNLGSKEVEAIADPAVRQIVQAELKEVGGDARKLENNWPLLPNRHGKPVPIRKVRVNLNRAVVSVGKGPWQRWAEPSETHHIEIYEVTSRGKTAWSGDVVTMRDAIGR

SEQ ID NO: 478 - protein, 911 aa, Unknown
  Description of Unknown: uncultivated organism with predicted taxonomy: candidate division Zixibacteria bacterium CG_4_9_14_3_um_filter_46_8
  MG4-57 effector
MEGKKVGGYILGLDIGANSVGWAILSQKDGKPTGIVKTGVRVFEAATEGDISAGKDESRNKKRRQMRLQRRQAERRARRKRKVFNLLVKSGLLPPGHITGVINDIDKAAYAKYVASADKSARPILAHVVPYILRARALDHPLSREELGRALYHLCQRRGYKSNAKMQEDEKEKGEVKEGIGKLEQAIKASGARTLGEYFSKINPEEERIRQRWTSREMYENEFEQIWEAQKKHYPELLTDALKEKMRDAIFHQRKVTWDKNTIGDCELEPGQKRAVAALLICQRFRFLQRLNDLKIISPLGEIVDLTPEQRRALAEKLDVEGDLSWTKVRKILQLTKEHHFNLEKVSDKGLIGNRTAGKLHKIFGDKWLSFTEEQRNRIVDDVRSFEDRRALALRAMKTWGLTDEKAADLAAVAFEPDYFNLSLRAIRKLLPLLENGMPFATARDQVYGKPKPVEPVDALPVVNEALPALRNPVVARSLTQLRKVVNNIIREYGKPAAIRVELARDLKRSKKQRQTLTERIRSREKLREDARKRLENEKLVERPTRNDIDKVLLADECNWICPYTGRQIGWKTLFGPSPQFDIEHIIPFSRCLDDSLANKTLCDIEENRNVKRNRTPWEAYGSNPEKWGQILDRVRRFKGDDAILKLQRFQLKDVGDFEEFSSRQLNDTRYASVLAAKYLGALYGGAIDAEHTRRIQVSAGMVTAYLRNEYGLNPILGDGGEKSRDDHRHHAIDAICVALTDAATVKMLSDAASRALSERRRQFGHIDPPWPSFLADVRKHIDDLIVSHAVSRKVNGPLHEETLYTKPRIDKDGNQVVCVRKPLDALSESEAKQIVDPVIRKMVLDRIEKEGAPPKKVFADKSRHPVICGKNGTRIPVHSVRIAKTGSVIPIASGGRSRNIMPGSNHHMEI

SEQ ID NO: 479 - protein, 976 aa, Unknown
  Description of Unknown: uncultivated organism
  MG4-58 effector
SGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQRPLRDTEDLVGECAWIPREKRAPVWSLDYQRYRVLQTVNHLRVAENRCAPRPLTHEERWRLLEELEKKPKVTVAQAKRVLGLQKAEFTVEEGGEKELPGDKVAAQFYEKLGESWSRLNPEERRALVECVATAESDEQLSETLQQQWGLSADQANKVVREVHLPSGYAPLSLKAIRAVMPYLEQGMDVQRARLAAGIPLDRPVPVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNPPAQIEHIIPFSRSLDNSFVNLTLAHVSDNAYKGDRTPREAYGSDPERWNEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHRVTGALHKETFYTRIGKNEKGGDVVRVRVPVTGLGSKDVEAIADPAVRAIVRAKLEEVGGNAKKLENNWPLLPNRNGKPVPIKKVRVNLNRAVVSVGKGRWQRWAEPSETHHIEIYEVTSRGKTAWSGDVVTMRDAIGRASRGEPVVRRDGGPNSRFLFSLAKEDTLRLQGEKPGIWVVKKIRANTQMMLVPQYDARKEKDSSNGRESFSPTPGGLQKYSAEKVLVLPIGDVVRCNE

SEQ ID NO: 480 - protein, 1057 aa, Unknown
  Description of Unknown: uncultivated organism with predicted taxonomy: Proteobacteria
  MG4-60 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRTRYTHRSMYEEEFEAIWEAQRRHHAALTRELKDRLWQILFEQRPLRDTEDLVGECAWIPGEKRAPVWSLDYQRYRVLQTVNHLRVAENRCAPRPLTHEERWRLLEELEKKPKVTIAQAKKLLGLKKAEFTIEEGGEKELPGDKVAAQFYEKLGESWSRLNPEERRALVECVATAETDEQLSETLQQQWGLSADQANKVVREVHLPSGYAPLSLKAIRAVMPYLEQGMDVQRARLAAGIPLDRPVSVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHRVTGALHKETFYTRIGKNEKGGDVVRVRVPVTGLGSKDVEAIADPAVRAIVRAKLEEVGGNAKKLENNWPLLPNRNGKPVPIKKVRVNLNRAVVSVGKGRWQRWAEPSETHHIEIYEVTSRGKTAWSGDVVTMRDAIGRASRGEPVVRRDGGPNSRFLFSLAKEDTLRLQGEKPGIWVVKKIRANTQMMLVPQYDARKEKDSSNGRESFSPTPGGLQKYSAEKVLVLPIGDVVRCNE

SEQ ID NO: 481 - protein, 1111 aa, Unknown; identical to SEQ ID NO: 464
  Description of Unknown: uncultivated organism with predicted taxonomy: Thermogutta terrifontis
  MG4-61 effector

SEQ ID NO: 482 - protein, 1054 aa, Unknown
  Description of Unknown: uncultivated organism
  MG4-62 effector
MSTPSNVPYVLGLDLGVASIGWAVLDTDAKGRPTSIRAAGSHLFEAGVGGGSQSTPEMAMARGKEESKAAPRREARAMRRQTMRRARRKKKLLGALIRHGLLPEGDIRTPAAIDAYVKALDAALRATWCPPGSSHVEYQNMAYRLRAEAAQRPLDAHAVGRALYHLAQRRGFESNRKTPKRDDEDTSDFQNKLDDLGDAIRSHTTQTLGAYLASLDPDEKRLRGRWTHRSMYEQEFETIWDAQAGALGLDGGAKQDIHHAIFYQRPLKDQSHLVGRCSLVPGKKRAPIAMRIAQDFRVLERVNHLRIVHDDHSERPLSKDERDNLLAALRREEKLTMHQAKKAAGLPTKHVKFSIEAGGETKLVGHRTDAKLCKIFGDRWDEMSEQEKDTVVEDVRCVRLPDTLRRIGEVRWGLSREKAQELADVQLEEGHSAHCLRALRKLVARMDADGLAYSTARKDEYPASFQSVEPMDLLPPVDAWEKDLRNPAVSRALTELRKLVNAIIDRHGKPVRIHLELARDLKQSRKKRKTASDRMRTREKEREKAAQRIITQPGLGIQHPKRWQIEKVLLAEECNWRCPFTDRGFCMADLLGSTPQVDVEHIWPYSRSMDDSFLNKTLCYHEENRNRKRGHTPMEAYGPTPEQYEAILDRVRRFKGDHFAVREKLRRFTDALDEDFPLRHLQDTRYITTLARDFVSLLYGKDASAIVTPSGPLTAWLRRGWHLNSVLGFTDEKEREDHRHHAVDAIVIALATRSNIKRLSDAAERVEREGREKAFGTVDPPWDGFEHEVRSIIDGVVVSHRQSQRVRGPLHKDTIYSPKIDGKHRVRKELHKLTAKEVQSGKIVDTRALAAIQAKLAELAKTDPALADPAKAFKAPENAPLVPGPNGSKVRLRRVRIDTGDKPTRFGGAKGKGSARYAKNELNHHVAFYDQPLPGGGVERTAEVVPLHEAMRRHASGEPIVDRTPRGKKGEYAFAFSLAKNGYVWYRQKNSDEPVLCMVDGIADGDIELKRHTDGRGRPQRGKDRIRLRSKSIREGLFEKAHVTYLGEVRRAGG

SEQ ID NO: 483 - protein, 787 aa, Unknown
  Description of Unknown: uncultivated organism with predicted taxonomy: Planctomyces sp. SH-PL14
  MG4-63 effector
PAGPASITQAKTAVNKLSDADKKDVAIVAITLDPEGDTRTDQWKRIRGRRTHRAMYVEEFEHIVQRQADFHPVLKDKAFVRRLSHAIFDQRPLKSQASLIGVCDLVPGRRRAAIASLPYQRFRLLQKLNDLSYVDHDGQKKRPTENQIRPLREKLQTEGDLTWATVGRLLGLDRKSKETGLPRLSHEEGGDKKLIGDRTSAKLRRVMAQKLDALSVAEQTAIIDEILSYGDVEEKLAERLRKAWQLTDAEAAEVAALRFEPGYGSVSRTAIARLMPHLEQGTPYATARKIEFGEVEESVPWPLLPPQGDNAKLWKENKKPDRLVYQSFSNPTVARCLSEMRKVVNALIRRYGKPAYIRVELARDLKNSRSRRADLTTRRNRNQARRERAKEAIEKECNNSRPSRFDIEKWLLAEECGFQCPYTGQSIPRHRVLSAEFEVEHIVPFSRSLDNSFTNKTLSHRDANAKKGNRTPMEAFGQPEEKWEQILARVKRFDGPFARRKLDLFQQRTPPEADFYERQLSETRYIARQAADYLGLLYGGRIEQRAGDEVGRRRVLVTPGRATALLRNGWQLASVTGGLKNRQDHRHHAIDALIVGLTQDGFLKQLSEAAARADELQLTRLTTEMDSPWETFLDDVGKGYERIHVSTRPTRKLNGPLHKETVFSKPHEASGSAKVFHAVRRPLQLMTKSEVGNIVDKRVREAVLEHLDRHDGDLTAAFGDPNNHPQLPCKDGRTIPIHRARVQRREKPWPIGKKSSKRYVVPGANHRLEIIARLNEEGEEIRWLGNI

SEQ ID NO: 484 - protein, 1054 aa, Unknown; identical to SEQ ID NO: 482
  Description of Unknown: uncultivated organism
  MG4-64 effector

SEQ ID NO: 485 - protein, 1041 aa, Unknown
  Description of Unknown: uncultivated organism
  MG4-65 effector
MPEQPKMTYVLGLDLGAESLGWAILETRDGEPVRIERTGVHTFEAGVEGDIESGKDESRAKARRDARLPRRQLWRRAARRRKVLHILQRHGLLPPGEARTPEQIHDLLLKLDADLRAAYLPAGDEVAAHLLPYRLRAKALDEKLEPWALGRVFYHLAQRRGFLSNRRSPERKDEDEGKVKAAIGELAADMKARGARTLGEYLAGLDPRCQGVRRRWTARTMFLEEFDRIWAAQAPHHPCLTEELRGQLRRALFFQRPLKSQKALVGRCELIPDRRRVALALPIAQRFRLLQKVNDLKVREPEGTERFLTPQEREKLARELDDKGDLKFDKVRKCLGLPRGVTFNLQEGGEEKLPGNRTYAKLKAVLGARWGGLSAADREQIVVELLSFQKPEALARRLMKVWNLDEPSATKLAEVRLEQGYARHCRKAIARLLPLMESGVPYATARKEVFPESFAAGTPVDRLPPVTDVLKDLRNPAVCRALTELRKVVNAIVRRYGKPECIRIELANDLKRPRKQREEISKRNRGRQKDREEAAEAIRSALPGLEPRRADIEKWLLAEECNWRCPYTGRSINAAALLGSTPQFDVEHIWPMSRSLDNTFANKTLCYHEENRARKGNRTPLEAYGSDPQRWEEILQSVRRFNGPLAWEKLRRFMAREIPQDFTDRQLQDTRYACRLAADYLGRLYGGRVDAQGKMRIEVRPGGLTAHVRNELMLHAILDDGGAKTRADHRHHAVDALAVGLTSQSMVQQLQTAAGRALQAGRRLFAPVPEPWTGFLEDARRSIGQIIVSRRPDRKVAGKLHAETFYSKPIPGADGDVRHVRKELRKLTLGEIQGDRIVDPVIRRLVQERHRQLGGGKPDSVFADPASHPVLRTRDGREVPIHKVRIRSKEKPWPIASGSRLRYVVAGGGTNHHLAIVARPGRRGRGEYWEDHIVSRYTAQQRLARGEPVIQKDWGPGRRLVMVLMPNDFIVMPDDRGVQQVYRVLSISEGDTELRLHCDARRAEDLKKARERVRVSGEKLRKLGGRRVEVSLLGELIGAHD

SEQ ID NO: 486 - protein, 1088 aa, Unknown
  Description of Unknown: uncultivated organism
  MG4-66 effector
MLQPLQVPYILGLDIGVQSIGWALVRLDEEGNPCGILRLGVRSFESSSGSEQEIEKGTDEPASRQRREKRLMRRQLFRRQQRLRRTARVLQQAGLLPPFPLQPASRDAAITQLDAQLRSQFIDSGNHVDAQLLPYRIRAAALDQPLPAYALGRAFYHLAQRRGFLSNKKAGGKKDEEEKGKVKAGIAELAKQIEAAGARTLGEFFARLDPHQQRIRSRWTSRKMYQQEFDAIWAAQEPHHPQILTAELKAKLYRAIFFQRPLKSQKGLIGRCSLEKGRRRAPLACLEAQRLRYWQKLNDMRLKDARRILNAIPEAEGLIDWLPQEGQGRLSLYAKQLLAQHLETSEELTFNQIRHILGLKKKKNSDLDFTFNLEEGDEKKLLGNRTAARLLKALGQRWQDMPEDQRQRLVDEILSFEKEEPLARRLEKAWGFTPAEAANVAALDFEQGYHSFSRQAIRKILPHLQQGQSLASIIKQLYKDTQPQATAWDRLPPLRDVFPHVNNPVVRRALTEVRKVVNAILRVYGKPQQVHIELARDLKKSRYERQQLFKGMRQQQKQREEAKSWLQCQMGITNPTAHDILKYRLWIECNQQCPYTGKPISKEALFGREPQFDVEHIIPFSRCLDNSFTNKTLCEIAENRNVKKNRTPYEAYGHDPQRWHEILQRVSRFQGDAAKAKLRRFQLTEIPADFANRHLNDTRYSSRLAAEYLALLYGGRSDAQGNLRVRAITGAVTAQLRDQWGLNAVLAELGRQLGVRDLDDNVEKARFDHRHHAVDALVIALTTPGMVKRFSDESQRARQYGRQLRCFFDPPWGTRTEFVADVRNAVLAINVSRRLDRRLKGPLHEETIYGKPKQYVDEKGKTIQVAHVRKPLESLSPKNVDDIVDPVIRELVKKKLQDLNTTDPKKAFQKKENHPYMIARDGRIIPIHKVRIRVTTETIMTVGHGPTLRHVKPGTNHHMEIVATLDAAGNEIRWEGITVSLFEALHRLRNKQPVVQRDHGPGKRFKFSLAGGEYLEFVENGQKKLVRVTTVYHSNVEFRLHNDARPITMLLGVKGARAGLGHSVDALRKLKARKVLVDPLGNILPAND

SEQ ID NO: 487 - protein, 1042 aa, Unknown
  Description of Unknown: uncultivated organism with predicted taxonomy: Proteobacteria
  MG4-67 effector
MSISDLSPSYILGIDLGAESIGWLLLDVDGDRPTAIRRAGTHCFDAAVEGDLESGKDESKAKARRDARSPRRQHWRRARRRRRVLRTLQQAGLIPPGPLASPIDIHELILRLDQALREKFIPADDRVAAHLLPYRLRAKALDERLEPFEVGRALYHLAQRRGFLSNRKAGKKGDDEGMVKAAISELSDRMTAAGARTLGEYFSGMDPEEERIRKRWTSRQMYLDEFEKIWTKQAEFHPQMTDEVKAQIHAAIFFQRPLKPQTHLIGVCDCDPPHRRAPVALRLAQRFRLLQKVNDLEVLEPTGFPRPLSSDERAKLIAALEQSGDLTFAKIRGKSILALPKETSFNLEKGGEKKLPGHRTDAKLAEIFGDKWPRLSEAERDQIVEDILTFEKSEALAARAQRAYGLDREAALRLAELELEPGYAMHCRKVLRQLVAKMEGGTRYAAARRELYPDQFQAKPAVDLLPPVKDALRNLRNPAVCRALTELRKLINAIIRRYGKPAEIHIELARDLKRSRKDRQELSKVIRENEKLREKAKERILRELGDQQPTRADIEKVLLAEECGWECPYTGKRFGMQELLGQNPQFDVEHIIPLSRSLDNSFGNKTLCYHEENRNHKRNRTPWEAYHADEQRWHQILERVRRFQGASARGKMRRFLMEAIPDDFTSRQLNDTRYASRLAAEYVGLLYGGRADAEHRQRVYVCTGGTTAFLRNEWKLNTILGDGGPKTRDDHRHHAVDALVIALTGPATVKMLADAADNPWQHRRRLFAPIQEPWVGFLDQAREAILRINVSHRVNRRVAGPLHDESIYSPPQRGVGSSPKVVPSYHIRKPLASLSIHEVEDIVDPIIRARVKAVLDEKGGDPKKVFSVAANLPALRTRDGRTIPIRKARIRKSQNMVAIGKGPTQRYVAPGSNHHMAIVAKVDSEGNDREWEGVLVSRLEAAERARRRVPVVQREWGEGRVFRFSLAPGEMFTLEDGNGKGLYIVRSISQNRVEFVKANDARKKVDIKAAKHWLTHPPSVLFRKRCQKVSVGYLGDIVPAND

SEQ ID NO: 488 - protein, 1061 aa, Unknown
  Description of Unknown: uncultivated organism with predicted taxonomy: Thermogutta terrifontis
  MG4-68 effector
MSAECQVRANEKNYVLGIDLGVLSLGWAVVEYAGDKPVGILKTGARIWEYSDASTLTVQKGQETPPGQERRQARQQRRQIFRRAQRLRRTCSVLQAMGLLDPGRRNSRARKQLWETVDQQAKEWLKSNIPGLADDPQLDHKFVYHLRAAALDHPLPKILLARVFFHLAQRRGFQSNRRVVSRSEEEGEVKKAISLLEHEISESGCRTLGEYFATLDPYTTRIRGRWTSRKMYQDEFERIWSAQIAINPGILDLSQKSRLFKAIFYQRPLKSQKRLVGRCSLEVIVRRGPDGPREVRPRQAALASLEAQRIRYMQRINDLEFTDPEGERRTPTQLEREQLYQLAETVEEISFSQIRKALGIPTGKKGAEWECNLERGGETKIPGNKTAARLRKILGNKTWDGFSESDQKKLVDTILAYLSPEALQSHLENVWKFDSDTARQLSNIELEQGYHSFSRRAIRKLLPLMHQGKRLNEAIKAVYGHTGRLRSVQERLPPVWKVMPELRNPLLVRALTELRKVINNLIRKFGKPQYIRIELGRELKLGKKRRQELAKEMRKREAERERAAKVIEETLHRKARPNEILKYLLADECDWECPYTGKKISVLTLLGDQPQFDVEHIWPFDRTLDDSFGNKTLCYHEENRQVKGNKTPFEAYSDSPDRWREILERVKRFKGPFAKEKLRRFLAADIPQDFPMRHLSDTRWITTAAADYLGYLYGGRIDSEGRQRVFTVTGPLTALIRRGWNLDGILGGPEKNRFDYRQHAIDAIVIALIDQAIVQQISLLSSRLWGTDRPTAVQLPEPWPSFYHDAKNAILNIVVSHRISRRLSGALHEQTHYAPPDNNGRTKIRKPLAALSAKEVENIVDDTIRKYVQHALANAEKKSPKEFFGNPENLPVLKGKNNHVAVVKSVRVWVSAKPVAVGNGDRVRYVKPGNNHHIEIYAIVDEHGNPVKYDGRCVTLLEAVQRKRRGEPVVCRNHGPNTRFLFSLSKNECIEWTNENGEKELLRVVGIADNDIEFRLLYDARPSNLVREAKDRIRGGYSKLFERRARKVLVTPLGEVLPAHD

SEQ ID NO: 489 - protein, 1059 aa, Unknown
  Description of Unknown: uncultivated organism with predicted taxonomy: Planctomycetes bacterium
  MG4-70 effector
MALVLGLDLGARSVGWALLEKQGDNWTRIVRAGVRVFEAGTEGNIEQGRDQSRGATRRIARLARRQIRRRRQRARALYRELASAGLLPEVTPSPGSPLAVLIQQAINDLDEHLRQKYAQESAVSQLPYFLRARALDHRLEPHELGRVIYHLGQRRGFKSNRKAEAREKADGDPLKEQKDKSVVYREIEELKAQIQDTGARTLGEYLSRVDPAVERIRHRYTQRRMYEEEFEAIWEAQRPHHAALTRELKDRLWDILFKQRPLRATDDLVGECDWIPGEKRAPVWSMDYQRFRLLQAVNHLRVSENHSAPRPLSSEERLRLLDVLETQSKISFAQAKKILGLRKAEFTIEEGGEKNLPGNAVAAQFYEKLGQDWIRLKPEDRQALVECVAVAESDEQLLEALKQQWGLSEDQARRIVQEVSLPSGYARLSLKAIRAVMPYLEEGWDVQRARIEAGIPLHRPVELHDLLPPLADSGVAVYNPAVKRVLTEMRKVVNAIITHYGKPDEIHLETARELRKSREEREKDSKRMREHEKEREAIIRRICEEIGIPETRISRDDVRKAMLWEECNGMCPYSGRSLGGFASLFSGNSPAQIEHIIPFSRSLDNSFVNLTLAHVSENAYKGDKTPWEAYGANPEQWDRILQRVALFKGSYKKAKLNRFKMDSNAVGEFLEQFSSRALNDTRAAAVAAARYLALLFGGETVGGKLKILKITGQVTAHLRDAWDLNGLIPSIHRETRGEAADKEPKTPPLKSRDDHRHHAVDAVVVALCDQGSIHRLSEASKTAVAARRRLLAPMAPPWVGFREQLKDILKSMNISFRPDHRVTGALHKETFYTKLGQNQKGGDMVRLRVPVTSLSSKDIENIADPTVREIVRAKLEEVGGDAAKLEKNWPLLPNRNGNPVPIKKVRVNLNRAVVSVGKGRWQRWAEPSETHHIEIYEVTANGKTTWSGDVVTMRDAISRASRGELVVRRSREPNSRFLFSLAKEDMLRLQGDKSGIWVVKKIKSNTQIVLVPQHDARKEKEKDKSNGRETLNPTASGLRKYYAEKVVVLPIGDVVVCHE

SEQ ID NO: 490 - protein, 1127 aa, Unknown
  Description of Unknown: uncultivated organism
  MG4-71 effector
MFSRANSVSDNDCSSVNAPAAPRDTASEAQPQPSQPSAGTNVPYVLGLDIGATSVGWAVLDLDAQGEPCCVRAMGARCFEAGVDGDIEHGKDSSRAVARRQARMARRILRRRARRLKKVFHLLQRHGLLPAGPSRTPEERHRLLADLDRQLFPKYAPGGDRVAAHVVCYRLRAAALDRALEDHELGRALYHLAQRRGFLSNRRDDRRASEKGEKSQDTKVIEKEIASLKEQITASGARTLGEYLSRIDPEQQRIRKRWTSRQMYIDEFEAIWSAQSQHRPGRLTEALKRELRQAIFHQRPLKPQTQLIGRCELEPPRHPGALPPRRAPLALPVAQRFRLLQKVNDLQVIEPDGRIRPLTAEERNKLLQALSEQARMEFDDVRKLLGLSAPRKRKDKATGQQICTPGHRFNLEEGGETSIPGDTTTARLLPVLGDKWRTMPEPLRESLVRDLLDFNYPAALAEHLQRVHRFDRHEAEALSEISLEDGYAPYCRMALRKLVARMENGTPFATARKLEYPQSFAAKPPCELLPPVRRAVPDLRNPAVIRALTEVRRVVNALIRRWGKPEIIRVELARDLKKPRKEREKAWKGNREREKERKAAADRLLKEAGITNPSPADIEKVLLMEECGGICPYTGRPITIPALFGDSPQFDVEHIIPFSVSLDDSFVNKTLCWHEENRHHKRNKTPYEAYSGNRERYEEILRRVSRFSGRFRKEKLRRFQMTLADVKAEYGDDFTARHLTDTRYASRLAADYLGLLYGGTVDAAGRRRVQTSSGTATWYLRSEWDMNAVIPGLSGSPTGSASGTFIEKVRTDHRHHAIDAVAIALTSARVVKMLADAARNPEQHRRRRFAPVPPPWPNFKDEVSAAAEKIIVSHRVDRRVAGPLHAETNYSPPIVHENREYRHRRVPLSSITRSQIAQIVDDVIRQLVEQKVGSAGDPAKVFSDPRNLPVLRSRDGTRCIPIKKVRVREHVAATTVGAGPRQRHVVSGKDTLHHTVIVARQTPSGEVWEDNPVDRLEVHRRLRNGQPVIQTDWGSDARYVFHLCKNDCIEMDVESGNPSAGRQIYVVRSISKRDIAVRLHYDARTLEQIVRAKERGKFRISSADLLRRRNARKVMVSPLGEVLPCRE

SEQ ID NO: 491 - protein, 1069 aa, Unknown
  Description of Unknown: uncultivated organism with predicted taxonomy: Acidobacteria
  MG4-72 effector
VSEHLDYVLGIDLGSNSLGWAVIGLIDGEPAQLVRAGVRVFDAGMEGDLESGREESRNLKRREARLHRRLLWRRQRRLTKLFNLLQRFDLLPPAPSISEHLPNGHRRPITPEQRQDLLNQLDRRILSSAWFQTKVNSGAFPEPEHTMPYILRAAALDEPLEPHMFGRALYHLGQRRGFLSNRKQAPKKNDDEGAVKEGIAELRKAMQTSGARTLGEYFSRLNPSTERIRCRWTARDMYEKEFNAIWDAQAPHHADLLTPERKKQIYDAIFFQRPLWLDPGTVGNCELEPGEKRAPAYLLVSQRFRLLQTVNNLRVLPPDDVDMPLTPTDRKKLVDALEMKGDLTFKEISKLLKLEKGYKFNLESGGEKRIKGNRTNADFYAVFGERWLAMSPEERDRAVEYVHSFQKAEKLKDAARKKYDLTEEQAEQLAGISLEADYINLSRKAIEKFLPLLEEGVTYGEARKKLYPESFEAREAMPLLPPVETALAQIRNPAVMRSLTELRKVVNALVRRYGKPSCVHLELARDLKKSKKQRQAISENNRRNESARAKAAEAIIKADVGISAPSPDDIRKVLLAEECHWTCPYTGRSISMRSLLGPEPQFDIEHIVPFSRSMDNSFQNLTLCYVPENRSVKGNRTPWQAYHGDPERYQAILDRVRKFAGDRQTVAAKLRRFTMTDDELEGFLEDFRNRQLNDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAQLEHRRRFASLEAPWPNFVDSVRTEIDRIIVSHRVSKKVSGALHEETIYSRPMGKDGEVRVRKPLDSLSRPEVEKIADEGVRKLVQQKLEQLGGIEPKKAFPNPENLPRFPSSGVVIKNVRITKPLPIFTLSEGRRARHVTSESNHHVEIYAELDEHGNEKKWGGEVVSMAEAYQRLKTGKPIVQRDHGPLVKFKFSLAPGEVVECEGKDGMRGLFVMRKASQLTSGQLQIGFAPLADARKAREIQTSRAWLWASPNTLGERNPRKVVVSPIGEVTETHD

SEQ ID NO: 492 - protein, 824 aa, Unknown
  Description of Unknown: uncultivated organism
  MG4-73 effector
MFSRANSVSDNDCSSVNAPAAPRDTASEAQPQPSQPSAGTNVPYVLGLDIGATSVGWAVLDLDAQGEPCCVRAMGARCFEAGVDGDIEHGKDSSRAVARRQARMARRILRRRARRLKKVFHLLQRHGLLPAGPSRTPEERHRLLADLDRQLFPKYAPGGDRVAAHVVCYRLRAAALDRALEDHELGRALYHLAQRRGFLSNRRDDRRASEKGEKSQDTKVIEKEIASLKEQITASGARTLGEYLSRIDPEQQRIRKRWTSRQMYIDEFEAIWSAQSQHRPGRLTEALKRELRQAIFHQRPLKPQTQLIGRCELEPPRHPGALPPRRAPLALPVAQRFRLLQKVNDLQVIEPDGRIRPLTAEERNKLLQALSEQARMEFDDVRKLLGLSAPRKRKDKATGQQICTPGHRFNLEEGGETSIPGDTTTARLLPVLGDKWRTMPEPLRESLVRDLLDFNYPAALAEHLQRVHRFDRHEAEALSEISLEDGYAPYCRMALRKLVARMENGTPFATARKLEYPQSFAAKPPCELLPPVRRAVPDLRNPAVMRALTEVRRVVNALIRRWGKPEIIRVELARDLKKPRKEREKAWKGNREREKERKAAADRLLKEAGITNPSPADIEKVLLMEECGGICPYTGRPITIPALFGDSPQFDVEHIIPFSVSLDDSFVNKTLCWHEENRHHKRNKTPYEAYSGNRERYEEILRRVSRFSGRFRKEKLRRFQMTLADVKAEYGDDFTARHLTDTRYASRLAADYLGLLYGGTVDAAGRRRVQTSSGTATWYLRSEWDMNAVIPGLSGSPTGSASGTFIEKVRTDHRHHAIDAVAIA

SEQ ID NO: 493 - protein, 1069 aa, Unknown
  Description of Unknown: uncultivated organism with predicted taxonomy: Acidobacteria
  MG4-74 effector
VSEHLDYVLGIDLGSNSLGWAVIGLIDGEPAQLVRAGVRVFDAGMEGDLESGREESRNLKRREARLHRRLLWRRQRRLTKLFNLLQRFDLLPPAPSISEHLPNGHRRPITPEQRQDLLNQLDRRILSSAWFQTKVNSGAFPEPEHTMPYILRAAALDEPLEPHMFGRALYHLGQRRGFLSNRKQAPKKNDDEGAVKEGIAELRKAMQTSGARTLGEYFSRLNPSTERIRCRWTARDMYEKEFNAIWDAQAPHHADLLTPERKKQIYDAIFFQRPLWLDPGTVGNCELEPGEKRAPAYLLVSQRFRLLQTVNNLRVLPPDDVDMPLTPTDRKKLVDALEMKGDLTFKEISKLLKLEKGYKFNLESGGEKRIKGNRTNADFYAVFGERWLAMSPEERDRAVEYVHSFQKAEKLKDAARKKYDLTEEQAEQLAGISLEADYINLSRKAIEKFLPLLEEGVTYGEARKKLYPESFEAREAMPLLPPVETALAQIRNPAVMRSLTELRKVVNALVRRYGKPSCVHLELARDLKKSKKQRQAISENNRRNESARAKAAEAIIKADVGISAPSPDDIRKVLLAEECHWTCPYTGRSISMRSLLGPEPQFDIEHIVPFSRSMDNSFQNLTLCYVPENRSVKGNRTPWQAYHGDPERYQAILDRVRKFAGDRQTVAAKLRRFTMTDDELEGFLEDFRNRQLNDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAQLEHRRRFASLEAPCPNFVDSVRTEIDRIIVSHRVSKKVSGALHEETIYSRPMGKDGEVRVRKPLDSLSRPEVEKIADEGVRKLVQQKLEQLGGIEPKKAFPNPENLPRFPSSGVVIKNVRITKPLPIFTLSEGRRARHVTSESNHHVEIYAELDEHGNEKKWGGEVVSMAEAYQRLKTGKPIVQRDHGPLVKFKFSLAPGEVVECEGKDGMRGLFVMRKASQLTSGQLQIGFAPLADARKAREIQTSRAWLWASPNTLGERNPRKVVVSPIGEVTETHD

SEQ ID NO: 494 - protein, 1059 aa, Unknown
  Description of Unknown: uncultivated organism with predicted taxonomy: Proteobacteria
  MG4-76 effector
MALVLGLDLGARSVGWALLEKQGDNWTRIVRAGVRVFEAGTEGNIEQGRDQSRGATRRIARLARRQIRRRRQRSRALYRELASAGLLPEVTPSPGSPLAVLIQQAINDLDEHLRQKYAQESAVSQLPYFLRARALDHRLEPHELGRVIYHLGQRRGFKSNRKAEAREKADGDPLKEQKDKSVVYREIEELKAQIQDTGARTLGEYLSRVDPAVERIRHRYTQRRMYEEEFEAIWEAQRPHHAALTRELKDRLWDILFKQRPLRATDDLVGECDWIPGEKRAPVWSMDYQRFRLLQAVNHLRVSENHSAPRPLSSEERLRLLDVLETQSKISFAQAKKILGLRKAEFTIEEGGEKNLPGNAVAAQFYEKLGQDWIRLKPEDRQALVECVAVAESDEQLLEALKQQWGLSEDQARRIVQEVSLPSGYARLSLKAIRAVMPYLEEGWDVQRARIEAGIPLHRPVELHDLLPPLADSGVAVYNPAVKRVLTEMRKVVNAIITHYGKPDEIHLETARELRKSREEREKDSKRMREHEKEREAIIRRICEEIGIPETRISRDDVRKAMLWEECNGMCPYSGRSLGGFASLFSGNSPAQIEHIIPFSRSLDNSFVNLTLAHVSENAYKGDKTPWEAYGANPEQWDRILQRVALFKGSYKKAKLNRFKMDSNAVGEFLEQFSSRALNDTRAAAVAAARYLALLFGGETVGGKLKILKITGQVTAHLRDAWDLNGLIPSIHRETRGEAADKEPKTPPLKSRDDHRHHAVDAVVVALCDQGSIHRLSEASKTAVAARRRLLAPMAPPWVGFREQLKDILKSMNISFRPDHRVTGALHKETFYTKLGQNQKGGDMVRLRVPVTSLSSKDIENIADPTVREIVRAKLEEVGGDAAKLEKNWPLLPNRNGNPVPIKKVRVNLNRAVVSVGKGRWQRWAEPSETHHIEIYEVTANGKTTWSGDVVTMRDAISRASRGELVVRRSREPNSRFLFSLAKEDMLRLQGDKSGIWVVKKIKSNTQIVLVPQHDARKEKEKDKSNGRETLNPTASGLRKYYAEKVVVLPIGDVVVCHE

SEQ ID NO: 495 - protein, 1057 aa, Unknown
  Description of Unknown: uncultivated organism
  MG4-77 effector
MALVLGLDIGARSVGWALLEKQGDEWKRIVRAGVRVFEAGTEGDIESGRDHSRGATRRIKRLARRQIRRRRQRARALYCALAEAGLLPEISPQPGSPMSLLIQQQINRLDGQFRIKYAAHPAVQQLPYLLRARALDQPLELFELGRVIYHLGQRRGFKSNRKAESRKAGAGDHSRAKEEKGKVYEGIDALRTLIDQAGARTLGEYFSRIDPAKQRIRGRYTHRSMYEQEFDAIWAAQKPHHPALTQELKDRLWNILFQQRPLQDKEEFVGECSWFPGEKRAPVWSLEFQRYRIWATLNHLRITGNRSAPRPLSPEERALLFTSLDAAEKLTIAQAKKALGLRRTAGFTLEEGGENHLPGNKVGAKFHAILGNRWTSLPPEKQNELVTVVARASTDEELEEALQRDWGLDGEMSRRIVREIVLPSGYALLSLRAIREVMPFLQQGYSVQEARQKAGIPLERQVPVHPLLPPLADSGVAVFNPAVKRTLTELRKVVNAIIRHYGKPDEIHIETARELRKSREERAEDSKRMRGREREREAVRDQIHKEIGIPLDQISREDVLKGLLYRECEGMCPYCGQSLGGFASLFGGNSPVQIEHIIPFSRSLDNSFVNLTLAHVSDNAEKGNRTPWEAYGHDPGKWEQILQRVGAFKGSYAKAKLNRFKMDEQAVADLLQQFSSRHLNDTRAAAVAAARYLALLYGGETVDGKRKILKPTGQVTAYLREVWGLNGLIPSIHREAAGAEESDDGRTIRKSRDDHRHHAIDAVAVALCDQGTIQMLSEANRGAAAARRRRFAPVPPPWVGFKDELRQVLRSMNISFRPDHRVTGALHKETLYKYVGRNERDGDVVRVRVPVHTLSVRELGQIVDPNVRVIVQAKLAEIGGDLKKLENNWPCLPNRNGAPVPIRTVRVDLNRAVVTVGTGFRQRWAEPSETHHIEIYEISENGRTVWTGDVVSMREAILRAARGEPVVRRSAGANGRFLFSLAKEDTIRLFGDRAGIWVVKKIKGNEQIILVPQHDARKEGSGAASRTEFAPTAGGLRRYSAEKVTTLPIGDVVPCHE

SEQ ID NO: 496 - protein, 1031 aa, Unknown
  Description of Unknown: uncultivated organism
  MG4-78 effector
MLIPNDSLVLGLDIGSSSVGWSLIQNRGEAVEIVASGVRVFPWTVDEQTLMSRSVERRRARQRRRQLERRARRRRLVASLLQRQGFLPPGPPDHRDPSWKAVLAMDPYELRGRALETRLEPWEFGRVMYHLAHRRGFAGSGRGADDSETGVIQEQIEKTAREMQKVNARTLGEFLAQLDPRERRRRGWHTAREWYRTEFEAIVQAQQRMGLNLDPDWVKRLRRAIFFQRPLRTSPRAVGRCGLVPGRLRAAWGLLEAQRFRYLQKLNDLRVLLPDGQVRPLTPQERELVRGELERSERLTFDRLRRLLSSCDPSEALGEPSTGKAGNCDEDPGARSTSDFSRQKAGLAFNLECGGQDCLPGNTTAARIRSAIGQKWDQASEDVRRAMVELLLGVKDRKLRARLALRRKEWALSDLEAERLAQVNLEPGRCRFSSAALRRLVPHLEAGCALTEAIAREFPEHEARFRTEADPPPETPVTNPLVRRALAETRRVVNAIVRTWGLPGRIHIELARELRKPLRRLRELLRRNEERQRQRKHAIKYLIEKGIQDPRPDQIEKFLLWVECKQICPYTGQSISDVDLFGPLPRFDVEHIIPWSRCLDDSFANKTLCEVDHNRNRKRNRMPTEVYSQDELSQILRRVRAFQGPYRFEKLRRFQMTEADLTTETGWLLRGDQLQATAHAARLAGRLLGRWYPAEERLSRIQITNGAVTSWLRVAWGLNQLLGVADEKNRSDHRHHLVDATVIALTTAATVKALTEAARRSARPRRFVDMPVPPGLVDSLRQQLETVIVSHRVDRRVQGPLHEETFYGRIQTPPTGESRTVVRKRIDALSATEAQRIVDPRVRELVAQVCNGRAPKEVFRDPSLIPEVPFGSRKVRIRHVRIWVSENPISLKDGDPRLVLPGSNHHLEIFDCREGPRPGWRCVVVSRWEAMRRLRAGKPVVRRFDEHGCPLVCSLARGETVRLNLPGGPVIAVVQKLSQDDYNFRLHTDGRRAADIPASERIRIRSSKALKKCLGCKLVVDVLGRCHVSRD

SEQ ID NO: 497 - protein, 1031 aa, Unknown; identical to SEQ ID NO: 496
  Description of Unknown: uncultivated organism
  MG4-79 effector

SEQ ID NO: 498 - protein, 1063 aa, Unknown
  Description of Unknown: uncultivated organism with predicted taxonomy: Planctomycetes
  MG4-80 effector
MLAGKTHPSGSRTAASEYLLGLDIGTTSIGWALIALKNEEPCGILRAGVRCFEAGVEGDIEEGKDSSRAKPRRIARLARRQIWRRAARARKVFRVLQELDLLPPGEARSPHARHALLHALDQKLLQKYDLARDHVKAHLLPYLLRAWAVKRRLERYELGRALYHLAQRRGYQTNRRAEADNDDEDNEKQRKIVQGSIETLQQDLAGRTLGQFLATLDPCQRRIRQRWTSRSMYQDELARIWQRQAAALGLTEEDRKQLYKAIFFQRPLRSARGLIGQCDLETGQRRAPLASLVAQEFRILQQVNHLRVRLPDHTERPLTDQERATLSQILMHQEELSCAEARKLLGLTKHGTKFTIELAREKSLRGNRTQARLVAVLGPRWDTFTPQERNELIWDVIHYEKAAALARRAQKRWGLDPQTAEKLANVRLETGYAAHSAAALEKLNERMRAGEAYATAKQAVYPHAHQPDRVVSRLPPVKEALGELRNPAVLRALTELRKVVNAILRRYGKPKAIHLELARDLRRSRKEREKISAEQAKREKARRDALQKMLREFPNYQPKRGYDPAIEKILLAEECDWECPFTGKKINMQTLLGKSPQFDVAHIYPRRYLDDSFANKTLCYHEENRHRMLDRLPMEAYAGNPQRWQEILARVKRFQGPYAAEKLRRFQTEKVPDDFVSRQLNDTRHSTKLAAQYLGLLYGGPYDAQGHRRLVAVSGSITAHLRRAWRLGVHPGPDQAGPGKNRDDHRHHALDAIVVALTSHATIQKLSTFAARSQPGQQRLITGDLQEPWPSFQRDVRQALMAIYVSFRAEHKLAGPLHAETNYSPPIPTPDGKFVHHVRKSLSKLTETEIRGDAIVDPVIRALVQKKFEELGGKQPEKVFADPANHPYLTARDGRRIPIHKVRIRARANPVRIADDPARQRWVAPSGNHHAVIVAQLDPQGRESRWEDHVVTRLEAHQRLRQAGPRPRNQLIQRDWGPGKRFKFSLMLNDMLELDAPGGGRQVCRVLGISKGDYELCLHYDARSQTEIARQKQRIRVNAEKLRLLRARKVVVTPLGDIQPAGG

SEQ ID NO: 499 - protein, 806 aa, Unknown
  Description of Unknown: uncultivated organism with predicted taxonomy: Rhodobacteraceae
  MG4-81 effector
MALVLGLDIGARSVGWALLEKQGDEWKRIVRAGVRVFEAGTEGDIESGRDKSRGATRRIKRLARRQIRRRRQRARALYRALAEAGLLPGISPQPGSPMSLLIQQQINALDAQFRARYAAETGVHQLPYLLRARALDHPLEPFELGRVIYHLGQRRGFRSNRKAESRKAGAGDESKANEDRGKVYEGIDSLRTAMQQAGARTLGEYFSRLNPAEKRIRGRYTHRSMYEQEFDAIWTAQKAHHPALTREFKDRISDILFRQRPLQDKEEFVGECSWLPGEKRAPVWSLEFQRYRIWATLNHLRITGNRSAPRPLSPEERALLFTSLDAAEKLTIAQAKKALGLRRTAGFTLEEGGENHLPGNKVGAKFHAILGNRWTSLPPEKQNELVTVVARASTDEELEEALQRDWGLDGEMSRRIVREIVLPSGYALLSLRAIREVMPFLQQGYSVQEARQKAGIPLERQVPVHPLLPPLADSGVAVFNPAVKRTLTELRKVVNAIIRHYGKPDEIHIETARELRKSREERAEDSKRMRGREREREAVRDQIHKEIGIPLDQISREDVLKGLLYRECEGMCPYCGQSLGGFASLFGGNSPVQIEHIIPFSRSLDNSFVNLTLAHVSDNAEKGNRTPWEAYGHDPGKWEQILQRVGAFKGSYAKAKLNRFKMDEQAVADLLQQFSSRHLNDTRAAAVAAARYLALLYGGETVDGKRKILKPTGQVTAYLREVWGLNGLIPSIHREAAGAEESDDGRTIRKSRDDHRHHAIDAVAVALCDQGTIQMLSEANRGAAAARRRRFAPVPPPWVGFKDELR

SEQ ID NO: 500 - protein, 1081 aa, Unknown
  Description of Unknown: uncultivated organism
  MG4-82 effector
MESKRLKQPFVLGIDLGVQSLGWAMLSLDDDDNPTGVVRLGVRCFDSGVGSEEEVAQGKEQSQNVERRGARLLRRQTWRRARRIAKVFHALQRFGLLPAEPAPTPEQRDALIKQLDADLRAEFLPAGDRAAFHLLPYRLRALGLDQPLPPFAFGRALLHIAQRRGFLSNRKAEGKENEKERSVVKESISFLQNELVRTGARTIGEYFAGIDPEEQRIRGRYTARQMYLDEFEKLWAVQAPHHQLDESAKKAIHQAVFFQRPLKSQSGLIGLCELEPGQRRAPAASLEAQRFRYLQKVNDLQIITPDGFILAPSEEQRRSLIDYLEHHAEITFDKLRTLWGLKLPRKSKKKSPAASGSDGDSDLASDAAQSDERPGYNFNLERGGEKKLKGNVTRARIEAALGCDLDELPAHVREPLVADVLEYENADALQRRLVQRYGLAEEQAAALAETHFEDGYASLSLAALRKFLPLMEQGMPFATARKELYKDSRQFQPHDILPPLFMVKAQLRNPAVSRGLNELRKVVNAVIRRYGKPKYIRIELARDLKQPRKVREERSKSMRKNEALRQQIIDDIRRFGIANPSETDILKVRLADECNWQCPYTGKAISMETLLGPHPQFDIEHIQPYSRSLDNSFTNKTLCDVHENRIAKRNLTPFEAYSGDEQRWHEIIARVRRFRGPASPAKLRKFLAKAIDSDFVERQLVDTRYMSRAAAEYVGLLYGGAVDSQGTRRVQVSPGGVTADLRRLWGLNRVLPRDPGDDERPGKKSRSDHRHHALDAAVIALTSPAMVQQLSRCAQDALLIGSRRFVALELPFPSLIDDLKKAIDEIVVSYRVKRKVRGRLHDQTYYSPPKPACDENGRTVEYRHVRKPLASISADRIEKIVDPVVRKTVQEHLARHGGDLKKAFGNPNNLPYLTAGDGRIIPIRRVRIRENISVLPIGKPPQLRFAAPGTNHHMEIVEVTDARGRVRWEGKLVNMFEAYQRRRQHLPVVCRDHGPNANFLFSLACGEYVEMEHVPGQRKVYRVTTISGERLEFRLHCDARPITVLKKLPKARINRSASTLLEAKARKVFVDPLGNVYPAGD

SEQ ID NO: 501 - protein, 1045 aa, Unknown
  Description of Unknown: uncultivated organism
  MG4-83 effector
MKTEYQKSGSVLGLDIGPTSVGWALIEENEQQPCRLIDMGVRIFEAGVEGDIESGRDESRAAKRRMARLHRRQLERASRRLKVLAEELQRRGLLPPGDVSTPDARKRFFDELDKLLAQGLDNPALLPFILRARALHERLDPHETGRALYHLAHKRGFLSNRKSQPKEDEELNTIAQAVGQLRQAMQETGAQTPGEHFAALLRNNGRVRGHHTFRNMNAQEFDLIWDTQRAFHPDVLSDEARKSIGKKIFFQRPLKSNKGLTGRCELEGARRAPLALLVSQRFRMLQKVNDLRLVSPDGLQRELTASERAELLRHLELQQNMKFTAIRKKLKLQGKFNFEIGGEESLPGNRTAARMASVFGQQRWQSMTPGEQDLAVQHVRSIRKPEALERAAADYWKLDPNAARAFAKISLEEGHVMLSQKAMSKLLPLMERGMPFATARKELYGAAPPPRAYDKLPPVHSPEMPAVTNPAVRRALTEMRKVVNAVTAKYGKPGLIRIELARDMKRPRKARQQISKRIRANKNKRDAARQQLLKEASGALGSAWEPKRSDIEKWLLRDECGGICPYTGKPISFHSLFVEPEFDIEHIIPFSRSLDNSFLNKTLCCATENRIKSKRTPWEAYGGTARWDEIIGRVRKFTGDANVAKLQRFQIRDADKEIDGFAARELNDTRYISRLAVQYAGLLYGAGADGVDPSGRRRVQAARGQITAHLRDVYELNSLLGDGGEKYRGDHRHHAVDALCVALTTPRAVKQLSDAAAAGEDRRRAWYDTRLITDPWPGFLDDARNAVNAIVVSHCPSRKVNSAMHDETVYSKPHADPMGRACVHVRKPLAALTDKMVDNIVDDRVREKVRQALNGRAPKDAFKDSASLPFFETRDHRRIPIKTARIRVYQSVNSLGRNAAARNVVPGSNHHVEIFAVEQEKGGVKWEGRMVTTIEAMARLHPKSRIPVVNRAHENGGKFLFSLSPGDTVRVTLDGEQKLLRLRTISKNNQGRLRLDAVCIREARKKAEIMQDKKWIIFPTLHALADMQFQKVTVTPLGEVFPCND

SEQ ID NO: 502 - protein, 1077 aa, Unknown
  Description of Unknown: uncultivated organism
  MG4-84 effector
MADPGLLKYVLGLDIGANSIGWALLTARGDERLTPTGIVQTGVRIFEAGVEGDLERGREESRGIQRRLARQARRRLDRTARRLAKVFGLLQDAGLLPRADTPASLPGVGVPREHMTARERRDERLRASAERDALLAQLDRELVAQCQDGLRAAGASQGEIWLVPHRLPYLLRARALDNKLPAHQLGRALYHLAQRRGFLSNRKAAPKKDEDQGVVDQGIQKIVAGMRETGARTLGEYFSRLDPTGERIRGRWTSRAMYQDEFDAIWAAQAPHHPEILTADLRKRLKRAIFYQRPLKVQKELIGECEFEKGRKRAPMALLVAQRFRLLQQVNNTRILTPDAVERGLTAEEAGKLIDALDTLGDITFKKAKRLLGLSQQHVFKFESGGEDKFIGNRTATKLIRVFGLDRWKTLKPSDRDRIVDDLLTIQKPETLARRAQRVWGLSPEAARELARTSLEDTHCRLSRLAIKNLLPLMETGMPYMTAARQVYGEKPAEPPRDSLPAVSEALPALRNPAVHRALTELRKVVNAIVRTYGKPAAIRIELARDLRKSPKQREQTWKKNRDNEALRKDAAEKLFREMGIQNPKRSDIEKMLLLQECGCMCPYTGKHISMRDLFGDAPQFDVEHIVPFSRSLDDSFLNKTLCEVAENRNVKGNRTPWEAYGHDLVRWNQILQRVSHFQGSAQREKLRRFQLQTIESPEQFASSQLNDTRYAAVEAMDFLKLLYGEEAQRKVIVQAARGGTTRFLREEFGLNQILGDGGEKSRDDHRHHAVDAICVALTDPATVKMLSDAAARALSEGRRRFASVPFPWGRFLDDVRASIQGINVSFRVSRKVGGALHEATFYSPPKKDPKTGQEHVHVRKPVTALSEQRVGNIVDPVVRAAVQAKLKEVGGDVRKLADNPPTLRAKDGREIPIRKVRLRESITPFGIGQGGARQVVTDTNHHVEIVQVPGKAGQPKWEGCVVSQYEALRRLRAKEPVVRRDHGNGRTFVFSLALGETVQMKGDDGQLALFKVAGVSQTGRGQIMLEFRRNADARPATVLRKIKGGRVFRTPDSLRSAMGTKVLLTPLGELRRVGRD

SEQ ID NO: 503 - protein, 1031 aa, Unknown; identical to SEQ ID NO: 496
  Description of Unknown: uncultivated organism
  MG4-85 effector

SEQ ID NO: 504 - protein, 1031 aa, Unknown; identical to SEQ ID NO: 496
  Description of Unknown: uncultivated organism
  MG4-86 effector

SEQ ID NO: 505 - protein, 1045 aa, Unknown
  Description of Unknown: uncultivated organism
  MG4-87 effector
MSSGYVMGIDIGVASIGWSVVEPGSEERPGRIVRLGTHLFEPGVDGTQTAIEQGKDEPKGAARRGARQVRRQLWRRAHRKRKLLFALMKHGIMPHATVPDGAAIDAYIKALDSRLRAAWCRAGDHQAHQIMPYLIRSAGVQRKITLEEFGRALYHLAQRRGFLSNRKAKKKKDEDTSQVKAEINELQSLIDRHVPATLGAYLASLNPDEQRLRDWWTARSMYLHEFEALWTEQSRHHRELTDEAKAAIHRAIFHQRPLKSQAHLIGRCSLEPGRKRAPLAHREFQYYRVLQGVNHLTIAPPGEAARKLDAAQRKVLTDALLAQGDLTIAKVRTLLKLPKGTDIAGERGEEEKKIVGHRTDAKLRDAIGPRFDAMSDRERDQLVLDLRSFRETEPLIGRLKSHWGLSDEQARKVADADLEEGYASYSLAAIRRLIPHLERGLSVSEARKAEYPESFRATQVHDLLPPVTDVMGDLRNPSVMRALTEARKVVNAIIRRYGKPEKIHVELARDLKHGRDRRAAITKQIRQREKQHADAKHRILAEIKGYEPTRIDREKVLLADECDWRCPYTGKKFGMKELIGEHPQVDVEHIWPFSRSFDNSFMNKTLCWHDENRRVKRGRTPYEAYSASPERYQEILGRVLAFKSDRRTVSEKFRRFTAEAIDEDFTNRHLSDTRYIARAVSEYLGVLYGGRTDADGKQRIVACSGGLTSWLRREWGLDALLSPTGDDAEAEKNRIDHRHHAVDALVVALTTPRTQAMLQAAAARQEQEGRFRLFGRIEPLWSAFPREAKAAVEAIVVSHRQQRAVSGKLHAESNYSKPIHGGHRIRKELHKLTRNEVSRIVDPRCRALVEAQLEKLGVDDPAKAFSKRENCPVIKGRDGVERRLRRVRLFSTASPTIVGQNARIRYVEPDSNHHCIVWAKRTKEGEEGPWEFEPVRLLDAYDRVCRGLPVVNRDGGSDRIFKFSVSINEFIEMDDPDSGGRQLYRIKKTSLREIGVQLHHDARTVDEVRKAGDLNKYRISPSALKSRNARKVFVNHLGEVSGAGG

SEQ ID NO: 506 - protein, 834 aa, Unknown
  Description of Unknown: uncultivated organism with predicted taxonomy: Planctomycetes bacterium
  MG4-88 effector
PREERIRQRWTSRPMYLNEFARIWSVQADAHGLTEEDRQRVFKAIFFQRPLKSQKGLIGRCELEPKHRRAALAMLVAQEFRILQKVIDLRVRFPDGTTRPLTADERQTLIDALQQVGEMTSASARKLLGLNKKGITFSIEEWGEKNLPGNRTNAKLAAIFGRRWLQFTPEERDQIVLEVLHYQKPAALVRRAMKHWGLDRQAAEKLSETRLEAGYARHSLAALTKLNASMRTGMPYMTAVKEAYPARFQAGKPMKLLPPVVKALRDLRNPAVCRALSELRKVVNAIVRLYGKPEKIRLELARDLRRSRKDRKRIAEQQREQETRRRKALERMMREFPNYQAKAGFDPAIEKILLAEECNWECPFTGRKIEMATLLGKNAQFDVAHLFPRRYLDDSFLNKTLCYHDENRHRMHDLLPKQAYGGDPQRWAEIIARVKAFKGSAATLKLERFLAAEVPEDFVESQLNDTRHNSKVAAEYLGLLYGGLWDASGKRRIEAITGGITALLRNAWRLRKDRADHRHHALDAIVLALVDPAQVKSLQESAERASEGSARFRLGELDEPWPGFRDAVRSALEEINVSIRADRKVGGALHAATNYSKPVRAANGSAVHHVRKPLHKLSVTEIEGDAIVDPVVRAAVQQRFADLGGKDPQKSFSDKANHPTLTAKDGRSIPIHKVRVRVREKAKMIAKGTVRQRFVTAGANSNHHCVIVAVLDAAGKETKWEEHIVDRLEANKRRASAPPGGMIQRDWGPARRFKFSLMPNDMLEMADESGTRQLYRVANISKGDYELRLHTDARESKELRSLKQRIRVHAEDLRRGRARKVTVTPLGEIQPAGD

SEQ ID NO: 507 - protein, 795 aa, Unknown
  Description of Unknown: uncultivated organism with predicted taxonomy: Planctomicrobium piriforme
  MG4-89 effector
MGFLMDASVSYGLGLDQGVASIGWAIVRLDAKGKAIGVERLGVHLFEAGTEGDIEGGRDESRAGPRRMARQARKQYRRRVLRKKRLLRWLQELGLMPAGDISTAEGRDKLLKDLDADLRTRWEADASIDHRLRQLLPYRLRAAGLTRRLEPFELGRALYHLAQRRGYLSNRKAQGASADPCAAGDATKPKKAGKGKKGTPAPPAEHAPAQPGASASPGEDQAGKGSGEAGGKEDPGVVRAAIVELERQMRGAGCTTLAEYFSKLDPTGTLGDRLRGRWTAREMFLEEFGRIMAEQAKHHPALTNEVQRKLHRAIFFQRPLQSMSHLIGTCDLVKGAKRCPLGHRLAQRFRLLQRVNDLDIRLPDFTRRPLTTEERGRLLAALDREGDIAFSTLKRKDWFGLPKGSTFNLEEGGEKKLVGNRTEAKCRCIFGDERWDAMSEADRDAVVHDLIVFEKPSALARRGESVWKLSPQRARALGDCVLEPGFAAHSKEALAVLVPCMEEGTPYAKAVQDKFKKVDATAEVRDRLPPVEKALGNLRNPTVTRALTELRKLVNAVVRKYGKPAWIRLELARDLKRARKQRERLSKEMREQEARRDSARAAIVRKAGLAGPSRSDIERYILAEECGFICPYTGKPMDRERLTDLVGRTPQFDVEHIWPLSRSLDDSYLNKTLCHVEENKAKGNRTPFEAYSQSPERWEQILDRVKRFGGTAARIKLERFTAKEIPDGFAERHLAETRKIGAASAGFLGLLYGGEIDAAHKRRVFVTTGGLTAHLRREWHLNGILGTEGEKARDD

SEQ ID NO: 508 - protein, 1097 aa, Unknown
  Description of Unknown: uncultivated organism
  MG4-90 effector
MSTPSNVPYVLGLDLGVASIGWAVLDTDAKGRPTSIRAAGSHLFEAGVGGGSQSTPEMAMARGKEESKAAPRREARAMRRQTMRRARRKKKLLGALIRHGLLPEGDIRTPAAIDAYVKALDAALRATWCPPGSSHVEYQNMAYRLRAEAAQRPLDAHAVGRALYHLAQRRGFESNRKTPKRDDEDTSDFQNKLDDLGDAIRSHTTQTLGAYLASLDPDEKRLRGRWTHRSMYEQEFETIWDAQAGALGLDGGAKQDIHHAIFYQRPLKDQSHLVGRCSLVPGKKRAPIAMRIAQDFRVLERVNHLRIVHDDHSERPLSKDERDNLLAALRREEKLTMHQAKKAAGLPTKHVKFSIEAGGETKLVGHRTDAKLCKIFGDRWDEMSEQEKDTVVEDVRCVRLPDTLRRIGEVRWGLSREKAQELADVQLEEGHSAHCLRALRKLVARMDADGLAYSTARKDEYPASFQSVEPMDLLPPVDAWEKDLRNPAVSRALTELRKLVNAIIDRHGKPVRIHLELARDLKQSRKKRKTASDRMRTREKEREKAAQRIITQPGLGIQHPKRWQIEKVLLAEECNWRCPFTDRGFCMADLLGSTPQVDVEHIWPYSRSMDDSFLNKTLCYHEENRNRKRGHTPMEAYGPTPEQYEAILDRVRRFKGDHFAVREKLRRFTDALDEDFPLRHLQDTRYITTLARDFVSLLYGKDASAIVTPSGPLTAWLRRGWHLNSVLGFTDEKEREDHRHHAVDAIVIALATRSNIKRLSDAAERVEREGREKAFGTVDPPWDGFEHEVRSIIDGVVVSHRQSQRVRGPLHKDTIYSPKIDGKHRVRKELHKLTAKEVQSGKIVDTRALAAIQAKLAELAKTDPALADPAKAFKAPENAPLVPGPNGSKVRLRRVRIDTGDKPTRFGGAKGKGSARYAKNELNHHVAFYDQPLPGGGVERTAEVVPLHEAMRRHASGEPIVDRTPRGKKGEYAFAFSLAKNGYVWYRQKNSDEPVLCMVDGIADGDIELKRHTDGRGRPQRGKDRIRLRSKSIREGLFEKAHVTYLGEVRRAGGWARARLRRSARAPFRSPRAAGHPRRRRTRGHHAIGRGRHRRGR

SEQ ID NO: 509 - protein, 930 aa, Unknown
  Description of Unknown: uncultivated organism with predicted taxonomy: Deltaproteobacteria bacterium
  MG4-91 effector
VSSQPRRQGYILGLDLGIASVGWACLEHDGQGKPTGILAAGTHVFEAAVENGQAADQTPAAKRRAVRSQRRLLWRRRQRRRKTARLLQQAGLLPVGPMDTSEELDKLIKDLDADLAKRWSGRVPPSRRDRLVYHIRAAAAQGPVEPDELGRAIYHLAQRRGFKSNRRTDRKADDKEIGKVKEGINELRRLMHEAGARTLGAYFATVDPHERRIRNRYTHRAMYEEEFEAIWSAQQPHHAVLTPELHDALHDALFFQRPIRKQPGLVGMCSLVQGKRRAPKALRAYQRFRMLQGVNHLRVDEPGRSARPLTAEERKKVIEALEREGDLTFAKLRQKKLLALPKEVEFDLAQAQFDRGEDKKGDRKIIGHRTDAKLRKVLGDRFDALTEEEKDQLVHELRSIPTEEGLIRRATRHWHFTMEQAEQLADLQLEDGYAALSLTAINRLLPHLEQGLSYAEARKREFPESFKSEDALDALPPVDKAIDNLNNPSVRRAMRELRMVVNALIREHGKPGRIHIELARELKHGRSRREQTERRMRERAKQREAAAETIIRETTARGFRIDKPRRDDIEKYLLAEECGWICPYTGRSIGWESLFGPHPEFDIEHIWPFSRSLDNRFLNKRLCHAATNRSVKKNRTPYEAFGQDTEQWEQILDRVRRFKGDPYARREKLRRFEAQEIDEGFLERHLRETSYFARLAQEYVGLLYGGIVDAEGTRRVIASSGGATHWLRRELGLDSILSDDEEKNRSDHRHHAVDAITTALLDSRTIQLLARAAQEAEERGSRRLFLSLQEEPWQGCRRDVEEAVARINVSHRQRRRVRGPLHEETNLSELINGGHRVRKALASLSPAEIKSDRIVDPRARELIRRALEEHAGGEITKKTITQVFSDENNLPLVPGPGGRLVRIRHVRVEVRDKPTLFGRDASRRWANTGS

SEQ ID NO: 510 - protein, 1062 aa, Unknown
  Description of Unknown: uncultivated organism with predicted taxonomy: Alphaproteobacteria
  MG4-92 effector
MTNGNLGKERFILGLDLGTNSIGWAMVGLDDNDKPCSVIRTGVHVFPAGTQGTDEDFAQGRDESRAQRRRMKRLLRRQIYRRKARARDAYKHLAEYGLLPKLEGYKGQNRDKAIKRLDVELLDRYLTAHPELIDEYELRDRVTAQTLVYRLRKEALDRQLQPDELGRILYHLSQRRGFKSNRKAPMKEDEKPGEVKAAIESLADEIKSAGARTLGEYFAGLDPEQRAIRRRKTDRSMYEQEFELIKKAQAPHHQRLDEKFWGRMRRILFYQRPLKSTKGLVGRCPLEPPRRRAPMASPAYQEFRLLQKLNDLCWIEVETGDSFALVDHPEHYETLYDALHKTDYLKFTEIAKLLKLKRNGKERTRFNLEAGGEKGLYGNRYASLMYQLFGENWQKEPSSCLSGIWQDLRSIQNETLLKRRAEEKWGLDASQIEILLQADIEEGYAAYSAKALQKLNQEMAQKIPFATALKSCYPEQAAEECVDLLPPYAEVGSDLRNPVVNRTLTELRKVVNAIVRRYGKPEKIRLEIVRDIKLGRKRRAEISKKMRTRQSEREDAKEQLRQWGVPVTHDAIERELLRRECNGVCPYTGREISPSQLFGESPQFDIEHIIPYSRSLDNSFANKTLCWHATNRNRKRGKTPYEVFSQDGDWEVILRRVAAFKGGYRDEKLRRFKLADLSEFDDFERRQLTDTAYAARLARDYLGVLYGAESLRRIQVLPGRLTSLLRGAWQLNRILGDPERNTKSRADHRHHAIDALVAAVTDRSMVQKICTRAKQLEDLKQVRLLPEIDPPWAGLLNDTREALARTIPSSRVDRKANGKLHEETIYGRILHKGEERTVLRRPLEALSSKEIDNIVDECIKDRVVQALEASGEKNPNKAFANPANLPRMVVRDRNGRSREVFIRRVRVFRSDNPVPVGRDRRLVKTGGNHHMELYEVRKKGERRMVGVIVTTLVAAQRKAARRSVYNCRLIPNGSYMFSIHKGDVLRLEHPRKGEVLVTIRKISRLPGGNYVEGTEIKDARLDKDIKPKSIENGWFKLSDKQLGEMQARVVRITPLGEELDRV

SEQ ID NO: 511 - protein, 1062 aa, Unknown
  Description of Unknown: uncultivated organism with predicted taxonomy: Proteobacteria
  MG4-93 effector
MTNGNLGKERFILGLDLGTNSIGWAMVGLDDNDKPCSVIRTGVHVFPAGTQGTDEDFAQGRDESRAQRRRMKRLLRRQIYRRKARARDAYKHLAEYGLLPKLEGYKGQNRDKAIKRLDVELLDRYLTAHPELIDEYELRDRVTAQTLVYRLRKEALDRPLQPDELGRILYHLSQRRGFKSNRKAPMKEDEKPGEVKAAIESLADEIKSAGARTLGEYFAGLDPEQRAIRRRKTDRSMYEQEFELIKKAQAPHHQRLDEKFWGRMRRILFYQRPLKSTKGLVGRCPLEPPRRRAPMASPAYQEFRLLQKLNDLCWIEVETGDSFALVDHPELYETLYDALHKTDYLKFTEIAKLLKLKRNGKERTRFNLEAGGEKGLYGNRYASLMYQLFGENWQKEPSSCLSGIWQDLRSIQNETLLKRRAEEKWGLDASQIEILLQTDIEEGYAAYSAKALQKLNQEMAQKIPFATALKSCYPEQAAEECVDLLPPYAEVGSDLRNPVVNRTLTELRKVVNAIVRRYGKPEKIRLEIVRDIKLGRKRRAEISKKMRTRQSEREDAKEQLRQWGVPVTRDAIERELLRRECNGVCPYTGREISPSHLFGESPQFDIEHIIPYSRSLDNSFANKTLCWHATNRNRKRGKTPYEVFSQDGDWEVILRRVAAFKGGYRDEKLRRFKLADLSEFDDFERRQLTDTAYAARLARDYLGVLYGAESLRRIQVLPGRLTSLLRGAWQLNRILGDPERNTKSRADHRHHAIDALVAAVTDRSMVQKICTRAKQLEELKQARLLPEIDPPWAGLLNDTREALARTIPSSRADRKANGQLHEETIYGRILFKGEEKTVLRRPLEALSSKEIDNIVDECIKDRVVQALEASGEKNPNKAFANPANLPRMVVRDRNGRSREVFIRRVRVFRSDNPVPVGRDRRLVKTGGNHHMELYEVRKKGERRMVGVIVTTLVAAQRKAARRSVYNCRLIPNGSYMFSIHKGDVLRLEHPRKGEVLVTIRKISRLPGGNYVEGTEIKDARLDKDIKPKSIENGWFKLSDKQLGEMQARVVRITPLGEELDRV

SEQ ID NO: 512 - protein, 1039 aa, Unknown
  Description of Unknown: uncultivated organism with predicted taxonomy: Planctomycetales bacterium 4484_113
  MG4-94 effector
MEDSPALLGIDIGPNSIGWALLDSEGKAIDDMGARVFEAGLADIEQDGKGKSRNVERRDARCIRRRLERTGRRLSKLARILQDAGLLPPGDVLSDEKRHQLVKRLDAQMDSPYSLRAKALDEKLKPYELGRALYHLAQRRGFLSNRKSAPKDEKEEGVVKEGIGQLRRDIDEAGARTLGEYFAKLDPHQQRIRGRYTSRKMYEDEFKMIWQEQRQYYPDLLTDDLKKAIHSAIFYQRPLKSAKHLIGGCQLENGKRRAPWALLIAQRYRYLSVLNNLTIRLPDGSERELTADERSKLIDYLEKNAELKFTTARGKKLLALPRGTKFNLEEGGEKRMLGNATAAKLRKIFGDRWDSFSEEEQDQIVEDIRSIVKDEALVKRGITKWGLDEESARKLTEVQLPDGYCRFSRKALEKLVPLLEQGKRLQTAIRELYPEKWARGSQPLDSLPPLSQCEDPALSELRNPIVSRALTEIRRVVNGVIAKHGKPDVIRVELARDVAQPAKRRQQAWKQNRQQERARKDAAERITKEAGIEKPSRDDILKVLLADECNWECPYTGRRINITELFGEHPQFDIEHIIPFDRCLDDSYVNKTLCEANENRNIKKGKTPYEAYYGTDKWENIISRVSRFNGRDRIKQAKLRRFKMHGEELEEFLDNFTNRQLNDTRYGSKLAKKYLGLLYGGVDNDGIDASRKRRVQATIGAVTAKLRDAMGLNAVLGKGAKSRDDHRHHAVDAVVIALTSPGTIKGISDASQHPALTDVRKIKLAEPWQGFLAEVRQAVDRIVVSHRVDRRVRGPLHEETFYGKPRKDESGKSYVHTRKPLSGISAKDVDSIVDPVIRRIVQQKLSELGESDPKKAFKDAANLPLDPQGRVVRRVRLKRNLEVFPIAKEEHRRRYVVLGNNHHMEIVGVGEPDEHGEHPKWEAHVVSMFEAYQRKKNKEPIVKRDWSDETEKDGKPRKFLFSLAGGDTIELQKEEGKRELFIVRTVPQMKQVRFVPINDARRLKDIGKVGFTAYPETLRKWHCRKVAVNPIGEVHYQND

SEQ ID NO: 513 - protein, 1072 aa, Unknown
  Description of Unknown: uncultivated organism with predicted taxonomy: Planctomycetes bacterium
  MG4-95 effector
MTNQEAEEKYILGLDLGSNSVGWTLLAARQGKPDTPLRPVGLVAAGTRVFDAGVEGDIEKGREKSRAVQRREARLARRGTDRRARRMHLVYSILERAGLLPSLDPPSNSSEGNSRGIREQESQLRHETLVTLDRELAEKWREKLRSEGADKDKLRQINHTIPYILRARALDEKLEPYEVGRAIYHLAQRRGFLSNRKSPLKKDEDLGKVKGDINKLQEKIEETGSRTLGEYFSKLDPEEERIRQRWTGRKMYEEEFGKIWAVQQKHHPNILTEDLKKQLIGSKRHPAIFYQRPLKSQKHLIGKCELEKDRRRAPMAILDFQRFRMIQMLNDTRVITPMGELREMTAEEREKLLAELDIKGDLTFAKAKKVLGLSREHHFNWEGGIEKRIIGNRTAAKLVEIFGIERWKGFSEEERNRIIEDVLSIQKEDTLFRRGINAWGLDEESAKKFSELQLKPDYARFSRRALKKLLPLMQQGIPYKTAEKQVYGDRLAADAHASLPAVADVLPELRNPIVNRTLNELRKVVNAVIRKYGKPALIRIELARDLRNSAKQRKNIMKKIEDNRKAREKAAEGILKEMPHFGEPKRADREKWLLADECNWECPYTGRQISVSALFGENPQFDVEHIIPFSRSLDDSFLNKTICEIAENRNVKRNYTPYEAYGRDEEKWNQILHRVKNFRGRAGNLKLERFQVKEAKFEDFASQQLNDTRYASKLAKKYLGLLYGKDAAKHVQAGRGGVTKFIRDELCLNAILGDGGDEKKRTDHRHHAVDAIAIALTSPGVVKMLSDAARYNEEKGLRRRFGNIKSPWPGFFEDVRKAVENIVASHRVSRRVNGPLHEETNYSPIKKDENGRDCVHIRKPVESLDKKNLKDIVDPVVRERVREWMEQANEHRPYPVHKTKDGREIPIKKVRIRKYDKPMTIGRDHRSRNVLSGSNHHLDIFEVTDKKGRPKWEGRLVSAFEAMQLKRQGKSVYSRERKEGGKFLFSLSQGEIIELDEKDGNRGLYRVRILSQLNQRGIKYPRVSYVRINDARLKADILKAKEWNTKLLEPLRKLNCRKVTITPLGEVRRAND

SEQ ID NO: 514 - protein, 835 aa, Unknown
  Description of Unknown: uncultivated organism with predicted taxonomy: Planctomycetales bacterium 4484_113
  MG4-96 effector
MEDSPALLGIDIGPNSIGWALLDSEGKAIDDMGARVFEAGLADIEQDGKGKSRNVERRDARCIRRRLERTGRRLSKLARILQDAGLLPPGDVLSDEKRHQLVKRLDAQMDSPYSLRAKALDEKLKPYELGRALYHLAQRRGFLSNRKSAPKDEKEEGVVKEGIGQLRRDIDEAGARTLGEYFAKLDPHQQRIRGRYTSRKMYEDEFKMIWQEQRQYYPDLLTDDLKKAIHSAIFYQRPLKSAKHLIGGCQLENGKRRAPWALLIAQRYRYLSVLNNLTIRLPDGSERELTADERSKLIDYLEKNAELKFTTARGKKLLALPRGTKFNLEEGGEKRMLGNATAAKLRKIFGDRWDSFSEEEQDQIVEDIRSIVKDEALVKRGITKWGLDEESARKLTEVQLPDGYCRFSRKALEKLVPLLEQGKRLQTAIRELYPEKWARGSQPLDSLPPLSQCEDPALSELRNPIVSRALTEIRRVVNGVIAKHGKPDVIRVELARDVAQPAKRRQQAWKQNRQQERARKDAAERITKEAGIEKPSRDDILKVLLADECNWECPYTGRRINITELFGEHPQFDIEHIIPFDRCLDDSYVNKTLCEANENRNIKKGKTPYEAYYGTDKWENIISRVSRFNGRDRIKQAKLRRFKMHGEELEEFLDNFTNRQLNDTRYGSKLAKKYLGLLYGGVDNDGIDASRKRRVQATIGAVTAKLRDAMGLNAVLGKGAKSRDDHRHHAVDAVVIALTSPGTIKGISDASQHPALTDVRKIKLAEPWQGFLAEVRQAVDRIVVSHRVDRRVRGPLHEETFYGKPRKDESGKSYVHTRKPLSGISAKDVDSIVDP

SEQ ID NO: 515 - protein, 889 aa, Unknown
  Description of Unknown: uncultivated organism with predicted taxonomy: Planctomycetes bacterium
  MG4-97 effector
MSTTRVLGLDIGTSSVGWALIEGRDPDHVRIIAAGVRVFPMGVDEATLESRNIQRRQARLRRRQIERRARRKTKARHILQSHGFLPPGDPSHADPAWASVLALDPYKVRAEGLHRRLQPYEFGRAIYHICQRRGFKSNRKRPLTKKEKGAVHEDIAGLKREMDAAHAETLGEYLNRLDPRQQRRRGRHTNREWYREEFRQLCERQRDFGLPLSPALQKELEETIFSQRKVWWKRGSIGRCSLEPGKQRAARALPVCQRFRMLQRVNDLQIILPDGTTRQLSDEEREKLLARLDWEENLSFKSIRKLLRLPAEARFNLEEGGETKLPGNSTAYRISRAIGKREWERCSPESKAQILEALMSIEDEDLFKRVALRKQWGLNEEQAERLSEVALEEGRLDLSTKAIRKLLPLMEKQRLSYAEAAWRVYGDRGPAQAYESVPPVEDLRNPTVQRSLAETRRIVNAVIRRYGKPDRIHIELARDLKAPKQIRLRRSRQMRRNEAERKSARKELIEQGLPEPTGRDIEKYRLWKECGKRCPYTGKMISFSDLFGPHPKFDIEHIIPWHRCLLDSFANKTLCEVQENRSRKGNRTPYEAYSGDPDRYEEIKQRVREFTGPFGKAKLRRFRCEDIQKLPESLPLYGGEQLNATAYAARYAARHLALLYPQEERRKRVQVSAGRTTAYLRRAWNLNRLIGLADEKNRADYRHHAVDAVVIALTTPKLTGELSKAAARSVRPGTFQGLTPPPGLTRQLEEILDQMVVSHRVDRRVNGQLHEETFYGRIDNDSVTVVRKPLADLTDRDVAHIVDKKVQRLVREKLSGGAPPSKVFANPANLPAFVSPSGRTMRIRHVRVRVDASPVRIGSGAKTRLVLTGGNHHLEVFRVVEDGREKWRG

SEQ ID NO: 516 - protein, 1034 aa, Unknown
  Description of Unknown: uncultivated organism
  MG4-98 effector
METAENNSVLLGLDIGPNSIGWSLLQPDNGTSPDVNLISGVHIFEGGLDDLETDGKGKSRNLDRRNARAVRRLLWRRAHRLQKLAVSLQGAGLLPDNSDLENPQQRNALFDKLDKEFKSPYQLRARSLDSKLEPYELGRALYHLGQRRGFLSNRKTPVKDEKELGVVKGGINDLSKKISEAGARTLGEYFANKVIPEGGRVRGHYTSRQMYEDEFELIWNKQKEYYPDLLNDEFKEKIHHHIFYQRPLKSQKHLIGECSLERGRRRAPWALLIAQRFRYLQRLNDLSYFDRDEMRERKIEGDQRKILIELFETKEKVSFGAIRKALKLRGIKFNLELGGEKNLPGNKTTARIIKAIGKTKWFSLSEREKEALVVDLRCIRKEETLKRRGIKAWGLDEEAAEKFGTIQLEDGYCNYSRQALQKLLPLLEKGVPLQTAIKELYPEQFENTGKPMDSLPPILESGLPELRNPVVMRSLTEIRKLVNAIIKRYGKPDIIRIELARELKQSPKQRQETTKRMRRNEKERNDIREQIRNETGIENPTYTDILKVRLAKECNWECPYTGTHISMQQLIGPHPQFDIEHIIPHYRSLDNSFTNLTLCEARENREVKRNRTPYEAYHDTAKWEDIIRRVERFDGPMRNAKLRRFLLQGEELEKFLDGFTNRQLNDTAWASKWAKKYLGLLYGDIKSKGIDSAGKLRVQAVSGRLTSELRRIWGLNNILGDGNTKSRDDHRHHAIDAIVIALSNPAVVKQLAEASKRAVNIGDKLLKDFPQPWEGFHNDVKRVIDGIIASHRVSKRVRGALHQGSNYGKPRKDKNGNQYVHIRKPIDGISKKEVENIVHPTTRKLVMDKLAELGESDPKKAFKEKDNHPRLMTKSGEFPIHRVTVRMNLSATFPVGKNYRTRYVISDRNHHIEIVEKPDGKWDGYVVSMFEAYQRKKNGEPIVKREFENDEKFLFSLANGEIIELDGPDNKSRALYVIRTIPQSKQLYFVPINDARKSGDIGRTGLTAIPNALKSRNCKKMLVTKLGEVRFAND

SEQ ID NO: 517 - protein, 1050 aa, Unknown
  Description of Unknown: uncultivated organism with predicted taxonomy: Planctomycetes bacterium
  MG4-99 effector
WTLLAARQGKPDTPLRPVGLVAAGTRVFDAGVEGDIEKGREKSRAVQRREARLARRGTDRRARRMHLVYSILERAGLLPSLDPPSNSSEGNSRGIREQESQLRHETLVTLDRELAEKWREKLRSEGADKDKLRQINHTIPYILRARALDEKLEPYEVGRAIYHLAQRRGFLSNRKSPLKKDEDLGKVKGDINKLQEKIEETGSRTLGEYFSKLDPEEERIRQRWTGRKMYEEEFGKIWAVQQKHHPNILTEDLKKQLIGSKRHPAIFYQRPLKSQKHLIGKCELEKDRRRAPMAILDFQRFRMIQMLNDTRVITPMGELREMTAEEREKLLAELDIKGDLTFAKAKKVLGLSREHHFNWEGGIEKRIIGNRTAAKLVEIFGIERWKGFSEEERNRIIEDVLSIQKEDTLFRRGINAWGLDEESAKKFSELQLKPDYARFSRRALKKLLPLMQQGIPYKTAEKQVYGDRLAADAHASLPAVADVLPELRNPIVNRTLNELRKVVNAVIRKYGKPALIRIELARDLRNSAKQRKNIMKKIEDNRKAREKAAEGILKEMPHFGEPKRADREKWLLADECNWECPYTGRQISVSALFGENPQFDVEHIIPFSRSLDDSFLNKTICEIAENRNVKRNYTPYEAYGRDEEKWNQILHRVKNFRGRAGNLKLERFQVKEAKFEDFASQQLNDTRYASKLAKKYLGLLYGKDAAKHVQAGRGGVTKFIRDELCLNAILGDGGDEKKRTDHRHHAVDAIAIALTSPGVVKMLSDAARYNEEKGLRRRFGNIKSPWPGFFEDVRKAVENIVASHRVSRRVNGPLHEETNYSPIKKDENGRDCVHIRKPVESLDKKNLKDIVDPVVRERVREWMEQANEHRPYPVHKTKDGREIPIKKVRIRKYDKPMTIGRDHRSRNVLSGSNHHLDIFEVTDKKGRPKWEGRLVSAFEAMQLKRQGKSVYSRERKEGGKFLFSLSQGEIIELDEKDGNRGLYRVRILSQLNQRGIKYPRVSYVRINDARLKADILKAKEWNTKLLEPLRKLNCRKVTITPLGEVRRAND

SEQ ID NO: 518 - protein, 1050 aa, Unknown; identical to SEQ ID NO: 517
  Description of Unknown: uncultivated organism with predicted taxonomy: Planctomycetes bacterium
  MG4-100 effector

SEQ ID NO: 519 - protein, 1034 aa, Unknown; identical to SEQ ID NO: 516
  Description of Unknown: uncultivated organism
  MG4-101 effector

SEQ ID NO: 520 - protein, 1056 aa, Unknown
  Description of Unknown: uncultivated organism
  MG4-102 effector
VFKDDMILGIDIGSNSVGWALLGYDADSREVTGITDAGVRIFEAGMDGDISTGNATSRCAERRAKRLIRRNLDRRRRRMLKLQHILQRAGLLPEGDDIEKIILDLDAEVRKFCLAVPEGERPSREVLAHTYPYFLRALAINGKLPPHLLGRAVYHLAQRRGFWSNRKSLVDEKELGQVKQGISELRGKMEETGARTLGEYFAYRDPTRDRIRGLWTSRDMYRHEFDLIMNNHPHLVTPDLRKSIEKAIFFQRKLKSVKSLIGHCALEKNKRRCPWYRFEAQEFRILQTITNLKVIEPDGELRELSAEEWENLYRVMMGETGDLDRHGNIKISKAKKLLGLPKGSKFTIEDGGEKTLKGNKTLSSLLAVFGDSWNEFSPRDKEDILHDLRSFEKREPLVRKAMRKWNLEQEEAEAFADIKLPEDYCNLSYKALCKLLPLLREGWSYGSAVKEIYPEAFKSDGIVHELLPGLDTSSIDLRNPVVERSLTELRRVVNAVIRKYGKPGIIRLEMAREMKLSANRKKEIIKRNRDLEKQREKAAEKIRDVFPGMTPGRTDTTKVLLAEECGWRCPYTGRSISIRTLFGPHPQFDIEHIIPRSRSLDDSFLNKTLCYHEENRNVKRNRTPYEAYHGTPRYDEILDRVAKFNGRLAKEKLRRFRMTPEEVEDRFADFTQRQLNDTRYAAKEAAAYLGMLYGGSVTSIDGRKRVQVLSGGLTYKVRSAYNLNGILNDGDVKTRNDHRHHAVDAIAIGMTSPGMVKKLTEIAKELENRRDYIRFGTGKGILPDKWNTFDEDVRRVIGKIKVSHKIPRKVRGAFHEETFYSKEYEHKVNGKTGMYRHVRIPLENLEKNKIPKVVDKGVREAIIRKLDELGIDDPRRAFRNGENLPEIVSADGAKRIPIKKVKIIRKQNTIRVGEGRRARNVVPGNNHHMMIYAVLDKRGEVKKWDGEVVTLLEARRRLMNGEPLVNKVNTPTARYVMTVQRGDVFEMDIKGKRELVITRDVPQTKQMSFVRLNDARLKKEIKSSGEWFTKRPNSMRTSNVKKFTITPLGELRNSNA

SEQ ID NO: 521 - protein, 1056 aa, Unknown; identical to SEQ ID NO: 520
  Description of Unknown: uncultivated organism
  MG4-103 effector

SEQ ID NO: 522 - protein, 867 aa, Unknown
  Description of Unknown: uncultivated organism with predicted taxonomy: Planctomycetes bacterium
  MG4-104 effector
LYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEVFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTT

SEQ ID NO: 523 - protein, 1021 aa, Unknown
  Description of Unknown: uncultivated organism
  MG4-105 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPEFFLQIDRAFLAGLPEDEQKRAAHVVPYLLRAAALDRPLAPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWAKDGQEYLCVIRGISLPQFSCMPINDARDVKTLKAAGLWFTPTLSAAFRGKMEKFHTTPLGELRRAND

SEQ ID NO: 524 - protein, 1022 aa, Unknown
  Description of Unknown: uncultivated organism
  MG4-106 effector
MKQRVLGLDLGISSVGWAVIDDDNTNRIELIDWGSRIFEPGVDATEDEIRAGKGESRCSVRRQKRSLRRMYQRRRRHKEEVTAILMREGMLPEKLTPEFFVKVDRDFLLTLPENERKRAAHVVPYLLRSLALDRPLDRYQLGRALYQLAQRRGYKSNRKQEAKDSESGKVLSGIADLKQAMADSGARTLGEYFSMLDPEESRIRTRYTERGMFEDEFHKICVAQRHIISVEVEAELHHAIFFQRKLRSCKHLIGNCRLEPDKKRCSYSTMAAQRFRLVQGVNNLKVSNKSGVIRELTEDERKMLLWCLDGLSGHLNSKGRIALSKLGKLVGLDKGEKFTLGDDDKDICGNELNAILFRAFGDKAVELSEAERNIFLNTLNSVENNAVMRKILMEKWHFNEETAEELSHIVLPDDYCNYSRKAIENLLPDMEAGIALNTIIKLKYPEQYQPSDVVEPVLPRLEEVDLDIRNPIVQRTLSELRRVVNAVIRKYGKPDLIRVELARDLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYVEIIERVRHFKGSFAKIKLEKFELETAEVQDFINRNLNDTRYASKLATEYLALLYGGMNDRNRVQRIQCSAGGCTAVVRRAWGGNYLLGEGEKVRGDHRHHAIDALTIAVTSPAIVKLIAGLKGEDRRRAIEEKRPLVVTDLYTQAKAKLDSAGISHHTVNKLRGALHKETIYSKSYGGDVRHARKALEDLEADKVKDIVDDAIRKAVEEKLDDLGIADPKKAFKGGTNLPVLRDRNGNIVNIIKRVRVLQTQSTRTIGSGDGQREVANGANHVLAIYSVLDKDGNEIGWDGEIVSLMDARLRMLKGEAVYPLEKNGNPLKFTLRKGDIVRWTKDGEELLCVIRGVALPQFQCVPVYEARDVKALKSAKKWFTPTLSAAFKGKMEKYTTTALGELRRAND

SEQ ID NO: 525 - protein, 992 aa, Unknown
  Description of Unknown: uncultivated organism
  MG4-107 effector
IDWGSRIFEPGVDATEDEIRAGKGESRCSVRRQKRSLRRMYQRRRRHKEEVTAILMREGMLPEKLTPEFFVKVDRDFLLTLPENERKRAAHVVPYLLRSLALDRPLDRYQLGRALYQLAQRRGYKSNRKQEAKDSESGKVLSGIADLKQAMADSGARTLGEYFSMLDPEESRIRTRYTERGMFEDEFHKICVAQRHIISVEVEAELHHAIFFQRKLRSCKHLIGNCRLEPDKKRCSYSTMAAQRFRLVQGVNNLKVSNKSGVIRELTEDERKMLLWCLDGLSGHLNSKGRIALSKLGKLVGLDKGEKFTLGDDDKDICGNELNAILFRAFGDKAVELSEAERNIFLNTLNSVENNAVMRKILMEKWHFNEETAEELSHIVLPDDYCNYSRKAIENLLPDMEAGIALNTIIKLKYPEQYQPSDVVEPVLPRLEEVDLDIRNPIVQRTLSELRRVVNAVIRKYGKPDLIRVELARDLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYVEIIERVRHFKGSFAKIKLEKFELETAEVQDFINRNLNDTRYASKLATEYLALLYGGMNDRNRVQRIQCSAGGCTAVVRRAWGGNYLLGEGEKVRGDHRHHAIDALTIAVTSPAIVKLIAGLKGEDRRRAIEEKRPLVVTDLYTQAKAKLDSAGISHHTVNKLRGALHKETIYSKSYGGDVRHARKALEDLEADKVKDIVDDAIRKAVEEKLDDLGIADPKKAFKGGTNLPVLRDRNGNIVNIIKRVRVLQTQSTRTIGSGDGQREVANGANHVLAIYSVLDKDGNEIGWDGEIVSLMDARLRMLKGEAVYPLEKNGNPLKFTLRKGDIVRWTKDGEELLCVIRGVALPQFQCVPVYEARDVKALKSAKKWFTPTLSAAFKGKMEKYTTTALGELRRAND

SEQ ID NO: 526 - protein, 1021 aa, Unknown
  Description of Unknown: uncultivated organism
  MG4-108 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPDFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMNEEERQAFFHHLACMEKDDALRRILRTRWGLSEEAAEKAAHISLPDDYCGFSCKALKQLLPDLESGIALSTVIKLKYPEQFQASERVLAFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKALKAAGLWFTPTLSAAFRGKMEKFHTTPLGELRRAND

SEQ ID NO: 527 - protein, 883 aa, Unknown
  Description of Unknown: uncultivated organism with predicted taxonomy: Planctomycetes bacterium
  MG4-109 effector
MQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEVFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTTPLGELRRAND

SEQ ID NO: 528 - protein, 1021 aa, Unknown
  Description of Unknown: uncultivated organism
  MG4-110 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPDFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGSSRKALKQLLPDLESGIALSTVIKLKYPEQFQASERVLEFLPPLDETGLQLRNPVVHRTLTEMRQVVNAVIRKYGKPDLIRLELARDLKNSSKDRENIARRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKLQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTTPLGELRRAND

SEQ ID NO: 529 - protein, 879 aa, Unknown
  Description of Unknown: uncultivated organism with predicted taxonomy: Planctomycetes bacterium
  MG4-111 effector
KEEVTAILMREGMLPEKLTPEFFVKVDRDFLLTLPENERKRAAHVVPYLLRSLALDRPLDRYQLGRALYQLAQRRGYKSNRRQEAKDSESGKVLSGIADLKQAMADSGARTLGEYFSMLDPEESRIRTRYTERGMFEDEFHKICVAQRHIISVEVEAELHHAIFFQRKLRSCKHLIGNCRLEPDKKRCSYSTMAAQRFRLVQGVNNLKVSNKSGVIRELTEDERENALVVLDGLSGHLNSKGRIALSKLGKLVGLDKGEKFTLGDDDKDICGNELNAILFRAFGDKAVELSEAERNIFLNTLNSVENNAVMRKILMEKWHFSEETAEELSHIVLPDDYCNYSRKAIENLLPDMEAGIALNTIIKLKYPEQYQSSDVVEPDLPRLEEVDLDIRNPIVQRTLSELRRVVNAVIRKYGKPDLIRVELARDLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYAEIIERVRHFKGSFAKIKLEKFELETAEVQDFINRNLNDTRYASKLATEYLALLYGGRNDRNGVQRIQCSAGGCTAVVRRAWGGNYLLGEGEKVRGDHRHHAIDALTIAVTSPAIVKLIAGVKGEDRRRAIEEKRPLVVTDLYTQAKAKLDSAGISHHTVNKLRGALHKETIYSKSYGGDVRHARKALEDLEADKVKDIVDDAIRKAVEEKLDDLGIADPKKAFKGGTNLPVLRDRNGNIVNIIKRVRVLQTQSTRTIGSGDGQREVANGANHVLAIYSVLDKDGNEIGWDGEIVSLMDARLRMLKGEAVYPLEKNGNPLKFTLRKGDIVRWTK

SEQ ID NO: 530 - protein, 1021 aa, Unknown; identical to SEQ ID NO: 526
  Description of Unknown: uncultivated organism
  MG4-112 effector

SEQ ID NO: 531 - protein, 992 aa, Unknown; identical to SEQ ID NO: 525
  Description of Unknown: uncultivated organism
  MG4-113 effector

SEQ ID NO: 532 - protein, 1021 aa, Unknown
  Description of Unknown: uncultivated organism
  MG4-114 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPEFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTTPLGELRRAND

SEQ ID NO: 533 - protein, 1015 aa, Unknown
  Description of Unknown: uncultivated organism
  MG4-115 effector
GLDLGINSVGWAIVDDDNDAQVDLLDWGSRIFAPGLAATTEEIVSGKGESRCAERRLKRAQRIAYRRRRQHKDELTRVLSGSGLLPEQVSPDFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMNEEERQAFFHHLACMEKDDALRRILRTRWGLSEEAAEKAAHISLPDDYCGFSCKALKQLLPDLESGIALSTVIKLKYPEQFQASERVLAFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKIRSIGEGDRKREVANGANLVLAIYARHDADGREIGWDGEVVTVLDARLRLQRNEPVFPKVKEGNPLKFTLRKGDVVRWSKDGQENLCVIRGISLPQFSCMPINDARDVKTLKAAGLWFTPTLSAAFRGKMEKFHTTPLGELRRAND

SEQ ID NO: 534 - protein, 1071 aa, Unknown
  Description of Unknown: uncultivated organism
  MG4-116 effector
MAHGLSEENDYILGIDLGSASLGWALVALSESGDPTGIIKLGVRIFEPAVSGDVEKGQDESNSVARRGARLIRRQRRRRAARQAALFRLLQKQNLLPGTTGVERDSSAQRHVILNELDSALSLKWRQRDSENGFVDLPIYHLRKAALYHALDPFELGRVFYHLSQRRGFRSNRKAERIEKKGEDQGAVKTAISELDEAIRAAGAQTIGEYFAGLDPHTQKVRRIWTGRSMYEEEFGKIWAIQSRFHPTLLTEELHREIWRLLFYQRPIKAQKNLIGECELEPGERRASWATLEAQRFRLLQKVNDLEIIYPGKLMGVALSADQRQHVYRLLDEHGDQTFKAIREHLGLDKNIGFNLERGGERSLKGNIVQRRMIEAFGPRWQALADEEKRQVVDDWRSIESPESLQRKLIAKWRLVPEAASRLAKSSPPSGYCMLSRKAIRRVLPLMFDGKRFMAARQEIPEYVPKLEAPLDRIPPVLDALRNLRNPAVERALTEVRKVVNALVGEYGKPSEVRIELARDLKKPRQERARATDLNRKRQRERDSVKERIVREGGLERPSRDDIEKVLLWEECGGICPYTGKSIAFASLFGEHPQFGVEHIIPFSRLPDNSFQNKTLCDHEQGRNVKRNKTPFEAYPNTEEYDAILTRIKAWETPNLGKQKRFELRTLEELEGFSTRQLNDTRYSSRLACDLIAKLYGGRVIETETGTRQVVFASSGMVTATLRKGLGLEAVLCEASGSSNGETRGKSRTDHRHHAIDALTIALTRQSMIQTMSRTASLEPNWAITSRSLRTIPSPWSNFIDSVRPHVQELLVSHRPEHRLTGALHDETNYSKPRKVNGKSVVHIRKPVNGLSANDIENIVDPVIRDAVRRKAIDLGGDLKRCNPNAGVDDWPQLVTKTGKHVPIKRVRISKSLEVETIATGNRTRYVATSSNHHLAIFAQIDSQGREKHWEPRIVSLYAAMDRKRKGLPVVQRFHPETGDFTFKFSLMGGDTVLLHKDCDHSKGICNASVWRLRTIASNGQLSLVRINDARLKADIQKAKEWWSPATDSLRKFSAIKVSIDSLGRLHGAND

SEQ ID NO: 535 - protein, 1062 aa, Unknown
  Description of Unknown: uncultivated organism with predicted taxonomy: Acidobacteriales bacterium 59-55
  MG4-117 effector
MSAALEQQKYVLGLDLGSASLGWALIALNDADDPVSLIRAGVRIFEPGVDGTSIEIEQGKDQSKAVERRTARLHRRQLRRRAARQRDLFRLLQRHSLLPTPEGVIGSPEEQRHLILNSLDQQLTDKWQSAFPINRFAELPIYFLRKAALDQPLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKVAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEVAFLFSLMKDDTVELEKDGTRGIYRVKKFEATGKITFVPVNNAMLDKMQYTTGAAWSRMPATLKPMSPRKIVIDLLGKVHPAND

SEQ ID NO: 536 - protein, 1071 aa, Unknown; identical to SEQ ID NO: 534
  Description of Unknown: uncultivated organism
  MG4-118 effector

SEQ ID NO: 537 - protein, 1062 aa, Unknown
  Description of Unknown: uncultivated organism
  MG4-119 effector
MSSALEQQKYVLGLDLGSASLGWALIALNDADDPVSLIRAGVRIFEPGVDGTSIEIEQGKDQSKAVERRTARLHRRQLRRRAARQRDLFRLLQRHSLLPTPEGVIGSPEEQRHLILNSLDQQLTDKWQSAFPINRFAELPIYFLRKAALDQPLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKVAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEVAFLFSLMKDDTVELEKDGTRGIYRVKKFEATGKITFVPVNNAMLDKMQYTTGAAWSRMPATLKPMSPRKIVIDLLGKVHPAND

SEQ ID NO: 538 - protein, 1071 aa, Unknown; identical to SEQ ID NO: 534
  Description of Unknown: uncultivated organism
  MG4-120 effector

SEQ ID NO: 539 - protein, 972 aa, Unknown
  Description of Unknown: uncultivated organism with predicted taxonomy: Acidobacteriales bacterium 59-55
  MG4-121 effector
LLQRHSLLPTPEGVIGSPEEQRHLILNSLDQQLTDKWQSAFPINRFAELPIYFLRKAALDQPLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMSRFAIQTEEALGDFSARQMNDTRYASVLASRFLGALYGGRDLVDAEKVRQVIFASSGAVTATLRSSWGLEAILREIVPTEPGEPRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRNGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 540 - protein, 853 aa, Unknown
  Description of Unknown: uncultivated organism with predicted taxonomy: uncultured bacterium
  MG4-122 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPGTLDGSPEEQRHSILNELDQALARKWQSAFPDNRFAQLPLYYLRKRALDEPLEAYEIGRILFHLIQRRGFLSNRRENKQNPDQKKELGQVKAEIHSLEQEIQNAGARTLGEFFAGLDPHAQKVRRRWTARKMFQDEFEKIWETQVIHCPNLLTPELHDKIAHLLFFQRPIAAQSHLVGKCELESGKQRAPWAAMEAQRFRILQKVNDLRLVNPGSLISDPLTEEDRQRLNSLLDREGDQTFKAIKKYLSFPADVQFNLEKGDEKRLRGNRTQAAMRKVFADRWDTMSAGKQHQIVENWRNSESDEALIREAEEQWSLDDTAATLLSEQIPEPGYCAVSLTAISKLLPLMQCGKSFKEAETEVYGARFSGGVVFDTLPEVRKQLESLRNPAVERALTELRKVVNAIVREYGKPYEIRIELARELKKPRQERLEATKKNRTRQREREDIAGRILRECGLSNPSRKDIEKARLHEECGGICPYTGRPIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTASLRSSWGLEAILHEIVPAESGESRGKPRTDHRHHAIDAITIALTRPKVIQSMARTASLEPWQIDSRAWRKIELPWRDFVPSIRPHIEQMLVSHRPEHKMSGELHKGTNYSAPYNYKGKPTVHTRCLLSALS

SEQ ID NO: 541 - protein, 1071 aa, Unknown; identical to SEQ ID NO: 534
  Description of Unknown: uncultivated organism
  MG4-123 effector

SEQ ID NO: 542 - protein, 1071 aa, Unknown; identical to SEQ ID NO: 534
  Description of Unknown: uncultivated organism
  MG4-124 effector

SEQ ID NO: 543 - protein, 1071 aa, Unknown; identical to SEQ ID NO: 534
  Description of Unknown: uncultivated organism
  MG4-125 effector

SEQ ID NO: 544 - protein, 1079 aa, Unknown
  Description of Unknown: uncultivated organism
  MG4-126 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKWTPKEGRGDWPQLGTKNGKQIPVKRVRIKKALSVETIGKDERTRHVALSSNHHVAIFAMLDKRGIEKRWKSIIVSLFEAMDRKRKGQPIVQTSYPEAGDYVFKFSLMGGDTVLLHKDCDHNQNPCNPSVWRLRSIAANGQLSLVRINDARPKSEIIKAKEWWSPIEDTLRELDAVKVVIDSLGRIHQAGG

SEQ ID NO: 545 - protein, 1076 aa, Unknown
  Description of Unknown: uncultivated organism
  MG4-127 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPGTLDGSPEEQRHSILNELDQALARKWQSAFPDNRFAQLPLYYLRKRALDEPLEAYEIGRILFHLIQRRGFLSNRRENKQNPDQKKELGQVKAEIHSLEQEIQNAGARTLGEFFAGLDPHAQKVRRRWTARKMFQDEFEKIWETQVIHCPNLLTPELHDKIAHLLFFQRPIAAQSHLVGKCELESGKQRAPWAAMEAQRFRILQKVNDLRLVNPGSLISDPLTEEDRQRLYSLLDREGDQTFKAIKKYLSFPTDVQFNLEKGDEKRLRGNRTQAAMRKVFADRWDTMSAGKQHQIVENWRNSESDEALIREAEEQWSLDDTAATLLSEQIPEPGYCAVSLTAISKLLPLMQCGKSFKEAETEVYGARFSGGVVFDTLPEVRKQLESLRNPAVERALTELRKVVNAIVREYGKPYEIRIELARELKKPRQERLEATKKNRTRQREREDIAGRILRECGLSNPSRKDIEKARLHEECGGICPYTGRPIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTASLRSSWGLEAILHEIVPAESGESRGKPRTDHRHHAIDAITIALTRPKVIQSMARTASLEPWQIDSRAWRKIELPWRDFVPSIRPHIEQMLVSHRPEHKMSGELHKGTNYSAPYNYKGKPTVHTRCLLSALSAAKIADDEVIIDTAVRDAVRKKLAELGGNPKLFDRPENAPCLCARDGRLIPIRKVRIRETKNPVKVGKGVRERFTSSGGIHHVALFVTRDEKRREKWDSEVAQVTEIYRRCPRNDRRKSRSQPVVIESPISRQLKSDPEAQFLFSVMKDDTIEVTDPNGIYILRVKKFSDNKQMWFVPVNDAHDDTQQMKLGITWSKTPNSLKELRPRKVVVDLLGKVHPAND

SEQ ID NO: 546 - protein, 1062 aa, Unknown
  Description of Unknown: uncultivated organism with predicted taxonomy: Acidobacteriales bacterium 59-55
  MG4-128 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 547 - protein, 973 aa, Unknown
  Description of Unknown: uncultivated organism
  MG4-129 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRD

SEQ ID NO: 548 - protein, 951 aa, Unknown
  Description of Unknown: uncultivated organism with predicted taxonomy: Planctomycetes
  MG4-130 effector
MAAAKKPYILGLDLGVQSAGWAMIDVDDHGRPCGIRRSGVRCFDSGVGSETEIASGKDESQNIKRRQMRLQRRQLWRRGRRLKKVFLVLQKAGILPPGETRSPEQRHELLKLLDAELAKTHLPEHDRVAGHLLPYRLRALALDQALPPFAFGRALFHLAQRRGFLSNRKSASKDGDDEGAVKAGIAELQQNMQEAGVRTLGEYFSKLDPEAEKQRIRKRWTARSMYLDEFEKIWVAQSPHHPMLGEEWKTRVYDAIFHQRPLKSQKGLVGVCELEPTCRRAPRASVEAQRFRYLQKVNDLEIVTPDGEIWALTDPEHVDLRKKLIELLDTQAEVKFASLRSKLGLWAKLGRKKPKGTDKDFTFNLEAGGESKLKGNTTATKIRGVLGDDYGKLSPEQLAGLVDDLLEYEKKEALARRLTKNYEIAPAKADQLADVTLEPNYASLSREAMHKLLPIMENGRRFASLTQEELEKLFPNRRKGGITYDLLPPVLGIIDLRNPVVCRGLTELRKVLNALIRQYGKPELIRVELARDLKKSRQQREDLTKQNRDNEKARDAARTKIAERLHCDENAVSNLDILKVRLAEECNWECPYTGKSIAIEALVGKHAQFDIEHIIPFSRSLDNSFLNKTLCDNHFNRHVKKNGTPHETCSSNEREWQEIIGRVKRFRGSAAHAKLRKFQQEKPDEDFAARMLQDTRYMSRLATEYLGLLYGGTIDADHTRRVQVSAGRVTAYLRDEWGLNAILADGGEEEKNRDDHRHHAVDASVIALTNAGTVELLSHSAEVAAERGRRLFVREEIQQPWPTFLDDVRRAIEAINISYRVNRRVTGALHEETNYSKPHKSRDGNGNGKEVEYRHVRKPLQNMSANEVENIVDDIIRKLVQTKLDQIGGEPKKVFADPGNHPYLTAKDGRRIFIHKARIRKTVAVIPLGKSSSPRYAAPGSNHHMELFATL

SEQ ID NO: 549 - protein, 1062 aa, Unknown
  Description of Unknown: uncultivated organism
  MG4-131 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 550 - protein, 835 aa, Unknown
  Description of Unknown: uncultivated organism with predicted taxonomy: Planctomycetes bacterium
  MG4-132 effector
MSVSAGSEHPYVLGLDLGSASLGWALIGIDAIETPVSLIRAGVRIFEPGVDGSALDIQQGKDQSKAVDRREARLHRRQLRRRVARQRELFGVLQGAGLLPTCDVPGAGIGSEQRHRILNALDMALTVRYRTGADKATFDQMPLYVLRKKALYEPLAFDELGRVFFHLSQRRGFQSNRKDVKKKTKEDEDQGQVKSAIYELEQAIQASDAQTLGEYLAGLDPHEQKVRRQWTGRRMFKEEFERIWVAQQAYHPSLLTPELHDRVWGLLFDQRPVSAQKHLVGKCELEPDKRRSPWAALPAQQFRVLQKVNDLRLLQENGKETPLYPQQRAAVFDLLENHGTQSFVKIKQHLGLPKTAQFNLERGKAKELKGNVTAQSMRKVFGVRWEEFSEGKQNQIIENWRNCEKDEDLKREAIEHWGLDEASANVLLAEKAPADYCALSLTALSKILPLMRAGKSFKEAETEVYDNRFSGAAVHPFIPVLRPHRKHFHNSTPPPQDPLMASIANGLRNPAVERAITEMRKVVNAIVREHGRPYEIRIELARELKKPRSKRLDETANNRKREAENRALAKRMHEECGIPQPPSRKDLEKAKLWVEQATGAGVCECPYTGKKLPFSRLFDDDNGFDVDHILPRSRHPDDSFQNKVLCWGEENRMHKRNQTPYEAYAEQDQERWQEILARVTRWKNPGKLRKFEIRSTDELEAFSSRQLNDTRYTSLLAARLLSTLYGGRDVTENGKNRQVIFASTGAVTATLRRNWGFEQILRGIIPAEPGESSGKPRTDHRHHAIDAIVIALTRNNVIQAMARASALEAWQSGTRSWRHVPQPWRTPDFFRSVEQ

SEQ ID NO: 551 - protein, 785 aa, Unknown
  Description of Unknown: uncultivated organism
  MG4-133 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNA

SEQ ID NO: 552 - protein, 1062 aa, Unknown
  Description of Unknown: uncultivated organism with predicted taxonomy: Acidobacteriales bacterium 59-55
  MG4-134 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 553 - protein, 1062 aa, Unknown; identical to SEQ ID NO: 549
  Description of Unknown: uncultivated organism with predicted taxonomy: Acidobacteriales bacterium 59-55
  MG4-135 effector

SEQ ID NO: 554 - protein, 1062 aa, Unknown; identical to SEQ ID NO: 549
  Description of Unknown: uncultivated organism with predicted taxonomy: Acidobacteriales bacterium 59-55
  MG4-136 effector

SEQ ID NO: 555 - protein, 1105 aa, Unknown
  Description of Unknown: uncultivated organism with predicted taxonomy: Acidobacteriales bacterium 59-55
  MG4-137 effector
MSVSAGSEHPYVLGLDLGSASLGWALIGIDAIETPVSLIRAGVRIFEPGVDGSALDIQQGKDQSKAVDRREARLHRRQLRRRVARQRELFGVLQGAGLLPTCDVPGAGIGSEQRHRILNALDMALTVRYRTGADKATFDQMPLYVLRKKALYEPLAFDELGRVFFHLSQRRGFQSNRKDVKKKTKEDEDQGQVKSAIYELEQAIQASDAQTLGEYLAGLDPHEQKVRRQWTGRRMFKEEFERIWVAQQAYHPSLLTPELHDRVWGLLFDQRPVSAQKHLVGKCELEPDKRRSPWAALPAQQFRVLQKVNDLRLLQENGKETPLYPQQRAAVFDLLENHGTQSFVKIKQHLGLPKTAQFNLERGKAKELKGNVTAQSMRKVFGVRWEEFSEGKQNQIIENWRNSEKDEDLKREAIEHWGLDEASANVLLAEKAPADYCALSLTALSKILPLMRAGKSFKEAETEVYDNRFSGAAVHPFIPVLRPHRKHFHNSTPPPQDPLMASIANGLRNPAVERAITEMRKVVNAIVREHGRPYEIRIELARELKKPRSKRLDETANNRKREAENRALAKRMHEECGIPQPPSRKDLEKAKLWVEQATGAGVCECPYTGKKLPFSRLFDDDNGFDVDHILPRSRHPDDSFQNKVLCWGEENRMHKRNQTPYEAYAEQDQERWQEILARVTRWKNPGKLRKFEIRSTDELEAFSSRQLNDTRYTSLLAARLLSTLYGGRDVTENGKNRQVIFASTGAVTATLRRNWGFEQILRGIIPAEPGESSGKPRTDHRHHAIDAIVIALTRNNVIQAMARASALEAWQSGTRSWRHVPQPWRTPDFFRSVEQQVAEVLTSHRPEHKVGGELHRGSNYGRPYMYNGASTIHTRKLISALKIEDIDADDVIVDRVIRDILRAKLAELGGNPKAFEKPENTPYMTTPAGKRIPIRKVRIRETRNPLRVGEGPRERYVASGGIQHVELFVARDEKRREHWLSHVVQTTEMYDLFPKRDHRPGRPKAVTKSIPIRRQMPGQPEAEFLFSLLKNDTIELEKAGCREIFRVKKFEATGKITFVPINNAMPDTLQYGTGSAWSKMPTTLKVMSPQKVVIDLLGRVHPAND

SEQ ID NO: 556 - protein, 1001 aa, Unknown
  Description of Unknown: uncultivated organism with predicted taxonomy: uncultured bacterium
  MG4-138 effector
DESNAVARRTARLIRRQLRRRAARQSELFRLLQTRGLLPSYQGSEADASQQRHTILNALDLKLAAKWAKSGSNEEQTAIELPLYLLRKTALDAALEPYELGRVFYHLSQRRGYRSNRKEQASGKEASGKAKKADDLGAVEGGIKELEEAMHPFRTLGEYFASLDPHIQKVRRRWTGRKMYEDEFAAIWAKQAAFHPDLLPEELHHQIKRLLFYQRPIKAQSNLIGGCELEPGERRAAWATLEAQQFRVLQKVNDLEIILPGNVTGIPLTPEQRKIVLDLLENSAEATFKKIRKALGLAENIGFNLQRGGDTRLKGNLTNTLMAEAFAERWPEMSNEEKMQAVEDWRTIEQKESLVRRAIEHWKLDETGAQWLAEKPAPNGYCMYSRKAIRKLLPLMATGTRFKAAEKEIYGNRLAGGKVYDRIPPVRDALKTLRNPAIERALTELRKVINALVHEHGKPAEVRIELARDLKKPRHERAKAVSYNRDREKQRTTAKEKMLREVGPGFQHPSRADVEKALLWEECQGECPYTGKRFPFSSLFGENPPLQVDHIIPFSRIPDDSFQNKTLCYHEENQHKGNRTPFEAYTDPAQYEAILNRVRSWRTPNPGKQRRFELRTLEELEGFSERQLNDTRYASKLACELVGTLYGGRDVPLKDGKSRQVVFASSGMVTSTLRKGWGLEAILREAAPSANGQNRGKPRTDHRHHAIDAITIALSRPKMIAALSRNNAQDPYWPNNGRTTPKIQSPWKDFVDSIRPHFEQMLVSHRPEHRLTGALHDETNYGRPRKEGGKDVVHIRKPLVGKNKGEGLSSEDIENIVDPAVREAVKEKAVQFGGSLKTWTPNAAQDDWPLLKTKTGKQIPIKRVRIRKAIKVFPVGETAYRTRHVAPGADSIHHIAVYVTKDKHGRDKWISEIVRIFEEKQRWQAWKKKGGAVVPLVYSTHSEDKDAEFLFYLMKKDTLELEVNGKRAVYLVTSFESDGRINLIPINSSGKREDQKDSKIV

SEQ ID NO: 557 - protein, 1067 aa, Unknown
  Description of Unknown: uncultivated organism
  MG4-139 effector
MTESGSSQSNYVLGIDLGTTYAGWAAISLNQSGKPTGVLRAGVRVFDTTVTGNVEKGQDESNAIARRNARLVRRQLRRHVARQKALFQLLQQHGLLPPYQGTESDSSRQRHQILNALDHELVIKRASTGDANAKAAVELPLYLLRKIALDAALEPFELGRVFYHLSQRRGYKSNRKEKPTDKKKVAELGVVESGIEDLTEEMHRAHARTLGEYFASLDPHAQKIRGRWTARKMYEEEFALIWEKQATFRPDLLTEELHHQVKHLLFYQRPLKAQSHLIGRCELEPGERRAAWATLEAQEFRLLQEVNNLEIILPGSVIGVPLTAQQRQTVLDLLENSAEVTFKQIRKALGLANNAGFNLQHGGETRLKGNATNAYMNEVFGERWSAMPDGDKKQVVEDWRTIEQEDSLVRRAVSHWHLDEANAQWLASRSAPNGYCAFSRKAISKMLPFLAAGKSGQEAEIKIYGSRLSGGKVYDRIPPVRDFLKNLRNPAVERSLTELRKVVNALVQEYGKPVEIRIQLARELKKSRRERMESVSTNRDREKQRNAAKEKLLKELGLQHPSRADIEKALLWEECQGVCPYTGKQFPFSSLFGENPSMQVQHIIPFSRIPDDSFQNKTLCSVEENQYKANRTPFEAYADPAQYEAILDRVKNWPRPNRGKQRRFELRTLEELEGFSSRQLNCIRYASQMACKLMGTLYGGRDMETAGRSRQIIFASTGMLTGTLRRAWGLEAILREETPSSIEGKPRNDYRHHAIDAIAVALSHPKLIAALSRSDDSYAWATRALLKIESPWKNFIDSIRPHFDQMLISHRPEHRLTGEIHKATNYSMPHEEDGKQVVHLRRPVPGLTMKDIENIVDPATREAVRAKAVEYGNELVKWTPNQGGTDWPQLVNKSGKHIPIKKVRVKEVLNVRAIGKGESTRYVALKNNHHVAIFALLNEVADEKRWVPVVVSLFDAMQRKNKSEAVIQTTYSGSGKAAFKFSLMGGDTLLLHKDCDHGNSKCNPSVWQVRTIAASGQLSLVRINDARQKADILKAKEWWSPSVETLRKLEAIKVTIDSLGGIHQAGG

SEQ ID NO: 558 - protein, 1114 aa, Unknown
  Description of Unknown: uncultivated organism with predicted taxonomy: Planctomycetes bacterium
  MG4-140 effector
FQGLDRSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRRIVVSRRPEHKLSGALHEATSYGKVRYYNAKGDPVRYQRIAIGKLLTDKQIEKIVDEEVKKSVVKLGETIGGYKKWSQEKHGWPKMPNRNGEPVPIKKVRIKITKNAKEIEAERFRGFGTGRPESNVEDKEIAYASFFTVQDRKGTKTVWEIVKLFEAAQRVRALPKSERGHEKICWKYPKYPDATFFRFSLMKGDLVELVLNGKPAIFIVRRFEFDSRLWVAPINAAGKDEEMEAAGHLLRLGFSRFLTMGAGDDKIPRPVFVDLLGQPHYINIGA

SEQ ID NO: 559 - protein, 1079 aa, Unknown; identical to SEQ ID NO: 544
  Description of Unknown: uncultivated organism
  MG4-141 effector

SEQ ID NO: 560 - protein, 764 aa, Unknown
  Description of Unknown: uncultivated organism with predicted taxonomy: Polaribacter sp. ALD11
  MG4-142 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGEYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEP

SEQ ID NO: 561 - protein, 1062 aa, Unknown
  Description of Unknown: uncultivated organism
  MG4-143 effector
MSSALEQQKYVLGLDLGSASLGWALIALNGADDPVSLIRAGVRIFEPGVDGTSIEIEQGKDQSKAVERRTARLHRRQLRRRAARQRDLFRVLQRHCLLPAPETLVGSPEEQRHSVLNELDQELTQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 562 - protein, 1076 aa, Unknown; identical to SEQ ID NO: 545
  Description of Unknown: uncultivated organism
  MG4-144 effector

SEQ ID NO: 563 - protein, 752 aa, Unknown
  Description of Unknown: uncultivated organism
  MG4-145 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNH

SEQ ID NO: 564 - protein, 1035 aa, Unknown
  Description of Unknown: uncultivated organism with predicted taxonomy: Acidobacteriales bacterium 59-55
  MG4-146 effector
LNGADDPVSLIRAGVRIFEPGVDGTSMEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 565 - protein, 1079 aa, Unknown; identical to SEQ ID NO: 544
  Description of Unknown: uncultivated organism
  MG4-147 effector

SEQ ID NO: 566 - protein, 1062 aa, Unknown; identical to SEQ ID NO: 549
  Description of Unknown: uncultivated organism
  MG4-148 effector

SEQ ID NO: 567 - protein, 1062 aa, Unknown
  Description of Unknown: uncultivated organism
  MG4-149 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLISEAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 568 - protein, 901 aa, Unknown
  Description of Unknown: uncultivated organism with predicted taxonomy: Polaribacter sp. ALD11
  MG4-150 effector
SASLGWALIALDESDNPVSLIRAGVRIFEPGVDGAKPGTPASAQEIQFGKDQSTAVARRQERLRRRQLRRRVARQRKLFGVLQGAGLLPTGDVLGAGIGSEQRHRVLNNLDADLMNRYRSSADKANFGQMPLYALRKKALYEPLALDELGRVFFHLSQRRGFQSNRKDVQKKTKGSEDQGQVKSAIHELEQAIQVAGAQTLGEYLAGLDPHEQKVRRQWTGRKMFEKEFQMIWDKQKEYHTDLLTSELHGRIWDLLFFQRPVAAQKHLVGKCELEPDKRRAPWAALLAQQFRLLQKVNDLRLIEEDGNELPLNEDGRIAVFNLLENHGTQTFAKIKQHLGLPKTAEFNLERGKAKELKGNITAQSMRKVFGERWTQFSAGKQNQIVENWRNSEKDEELRREAMEHWGLDEAGANALVNEKAPGDYCSLSLMALGKILPLMRAGKSFKEAETEIYGNRFSGAAVHSLIPVLRPNRKHFRNSTPPPQDPLMASIANGLRNPAVERSITEMRKVVNAIVREYGKPCEIRIELARELKKPRSKRLDETARNRKREAENKALAERMHNECGMPQNSSRNDLEKAKLWVEQQGQCPYTGRSLPFSRLFDDNNGFDVDHILPRSRHPDDSYQNKVLCWGDTNRMVKRNQTPYEAFAEQDPENWHQILARVARWKNPGKSRKFEIRSTDELAEFSSRQLNDTRYTSLLAARLLSTLYGGRDLAENGRKRQIIFASSGAVTATLRRNWGFEQILRNIIPPEPNESSGKPRTDHRHHAIDAIVIALTRNDVIQAMARASALEPWQPGTRSWRHVPQPWHTPNFFRSVEEQVREMLTSHRPEHKVSGELHKGSNYGRPYLYNGKPTVHSRVSISALRSQDIEDDDVIVDRRVRDILRTKLAEIGGNPKAFEK

SEQ ID NO: 569 - protein, 1105 aa, Unknown; identical to SEQ ID NO: 555
  Description of Unknown: uncultivated organism with predicted taxonomy: Acidobacteriales
  MG4-151 effector

SEQ ID NO: 570 - protein, 1079 aa, Unknown; identical to SEQ ID NO: 544
  Description of Unknown: uncultivated organism
  MG4-152 effector

SEQ ID NO: 571 - protein, 1062 aa, Unknown; identical to SEQ ID NO: 549
  Description of Unknown: uncultivated organism
  MG4-153 effector

SEQ ID NO: 572 - protein, 1076 aa, Unknown
  Description of Unknown: uncultivated organism with predicted taxonomy: Acidobacteriales bacterium 59-55
  MG4-154 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPETLGGSPEEQRHSILNGLDQALARKWQSAFPDNRFAQLPLYYLRKRALDEPLEAHEIGRILFHLIQRRGFLSNRRENKQNPDQKKELGQVKAEIHSLEQEIQNAGARTLGEFFAGLDPHAQKVRRRWTARKMFQNEFEKIWEAQVIHCPNLLMPELHDKIAHLLFFQRPIATQSHLVGKCELEPGKQRAPWAAMEAQRFRILQKVNDLRLVNPGSLISDPLTEEDRQRLNSLLDREGDQTFKAIKKYLSFPADVQFNLEKGDEKRLRGNRTQAAMRKVFGDRWDRMSAGKQHQIVENWRNSESDEALIREAEEQWALDDTAATLLSEQIPEPGYCAVSLTAISKLLPLMQCGKSFKEAETVVYGARFSGGVVFDTLPEVRKQLESLRNPAVERALTELRKVVNAIVREYGKPYEIRIELARELKKPRQERLEATKKNRTRQREREDIAGKILRECGLSNPSRKDIEKARLHEECGGICPYTGRHIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTATLRSSWGLEAILHEIVPAESGESRGKPRTDHRHHAIDAITIALTRSKVIQSMARTASLEPWQIDSRAWRKIELPWRDFVPSIRPHIEQMLVSHRPEHKMSGELHKGTNYSTPYNYKGKPTVHTRCLLSALSAADIAGDEVIVDTAVRDAVRKKLAELGGNPKLFDRPENAPCLSARDGRLIPIRKVRVRETKNPVKVGKGVRERFTSSGGIHHVALFVTRDEKRREKWDSEVAQVTEIYRRCPRNDHRKGRSQPVVTESPISRQLKSDPEAQFLFSVMKDDTIEVTDPNGIHILRVKKFSDNKQMWFVPVNDAHDDTQQMKLGITWSKTPNSLKELRPRKVVVDLLGKVHPAND

SEQ ID NO: 573 - protein, 1026 aa, Unknown
  Description of Unknown: uncultivated organism with predicted taxonomy: Deltaproteobacteria
  MG4-155 effector
MEIQVAVPYVLGIDLGANSVGWAALLHEHGESVGILDLGVRIFAAGVTGLEAGRDESHAAARRVARLQRRQTDRRRRRIHKIYGILADYGLLPAKATPADRAKALSALDNELSARYGAHDNLPYVLRARALGEALSPFELGRALFHLAQRRGFLSNRKSTKEPDDEKGKVKSGITILAHAIAESGSRTLGEHLSRLDPHEARIRGRYTSRQMYLDEFDKIWESQAANHPELLNPERKRELLQAMFHQRPLRDQSDLIGDCELEEGEKRAPAWHPLAQRFRLLQEVNHLRLIDPAGVSRALSAEERQAVVPLLEKGDLPIRELRKLLEIKRNVEINLDRGGKKALIGDRTEEKMRGAFGAAWDALSQEEKLEAITDLAGDLGDTQLARKAQDRWGLSAEQAERYSSTSLEVGRYLGFSLKAIAKMLPLLESGADATTARDAAYPAGTFRTDLLGALPPVAERLKDLRNPAVLRSLTELRKVVNALIGRYGKPLEIHVELARDLKASRPEREDRWARMRRNEKARAEAAAKIQSEIGIHTPGRADTEKWLLAEECHWRCPYSGRGFSATQLYQSGEIQVEHIIPFSRSLDDSFANKTLAYSWVNKAKGNRSPREAFQEQSQWEAILTEVGSFHGPYAKHKLQRFQWTSEQIAELLDDFTKRQLNDTRYASKLAARYMACLYGGLSDSCGQRIFVSPGQVTAFLRRLWAIEGLLSGGGGKSRDDHRHHAIDAVVVALTGPAWVKALSDAASRAREEGRRRFASLEAPWPGFAAAVQDRLQGLTVSHRANLKVGGAMHDETFYGVIQHPELGPTAVCRKLVHRLSKEDLEHIVDPRVRERVALQLGLQGGDFKQLEAHPPTIPTHDGREVPIRKVRIMKAEHTRRIGQGARARNVMGDDYHHLEVIRQTDPRTGKTKWALAAVTCQQAMERVRDHKPLVSRDHGPHAEFVCSVAKDDTLEINEAGNKRLVVVKALEAGRNVVGFKDLRDARPYSATTKNRERVAVARLMDALKCRKVTVSPLGETHYAND

SEQ ID NO: 574 - protein, 1037 aa, Unknown
  Description of Unknown: uncultivated organism with predicted taxonomy: Planctomycetes bacterium
  MG4-156 effector
SMLGVDLGSAALGWAVVGVADGKPACHVDGGVRIFPEAVENLEQGKDDPKSAQRRLARQMRRQTDRRARRVASVFRVLQKAGLLPRFSEGADPADPLARHELINRLDEDLACTVPGLIDPAAEHRSRSVFHYRLRALAIHQDLPPYAIGRAFLHIAQRRGFKSGRIEEASGSEKAKERESDSRKERRQVAARIESLPAEFLRLGACTIGEYWSKLDPNQKRIRGIGNWSGRQMHVDEFDRIWERQAPRQQEIMTPLLYRIVKRRIFFQRPLKSAAGLIGHCELERESQRRRAPLAHPLYQRFRILQTVNDLRIVEGSGLSRPLTVEQRIKALDTLSRQQTVTFKSLHKKLGLVPGETFSHEEGDRKDLPGNRTECKLREVFGEQWDSLPEQQKNVIAGYVRSMDDSAVLARIAETRWGLGHLRAARLAGIQLEQGYGRLSVAALRKLLPLMEEGLPYMTAVERIYPDRAFAPTQELLPKVLDLKNVRNPAVVRALTELRKVVNGVIREYGRPERIQIELARELKKPAKARERIAQENRQREDLRKKTIERIFRECGLGKPSNADIEKAILWEECQHHDPYTGGSINFHDLFGSDAKWEIEHIIPHSRSQDDSLTNKTLCSRETNRQKGNRTPFEVFGNTPEWEAMVERVTKFQGDKRAMTRKLARFTMEGGVEELFGEFTQRQLNDTKYASLLAMEFLGQLYGGVCDERGIRRVNAVSGGVTAQIRKGWRLHSILRDGPSQGEAKPRDDHRHHAIDALVIAMTDAGAVQAVSRASERSRLDHRHGFRVDDPWNGFLEQVQAVIRAIRVSHRPDHHLRGALHAESLYSPPRSERGAAPRHRIRKWLSSLTPEQVRDIVDTKVREAVEAKLKELGQTDPRDAFKNNADPPTLGNRHGDPVPIRRVRVYVSVSPQRIGTGATARHVVSKDNHHLAIYRLSADKKGTARWTGEAVSLLEALKRMNLPGRPVIAPVNESGAPLVMALYKGDLVEMTVPKSQPPERDLFVVRGFSIEKRGGPEINFARHTLAAEMASQKKRGG

SEQ ID NO: 575 - protein, 1062 aa, Unknown
  Description of Unknown: uncultivated organism
  MG4-157 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 576 - protein, 1062 aa, Unknown; identical to SEQ ID NO: 549
  Description of Unknown: uncultivated organism
  MG4-158 effector

SEQ ID NO: 577 - protein, 1062 aa, Unknown; identical to SEQ ID NO: 549
  Description of Unknown: uncultivated organism with predicted taxonomy: Acidobacteriales bacterium 59-55
  MG4-159 effector

SEQ ID NO: 578 - protein, 1075 aa, Unknown
  Description of Unknown: uncultivated organism with predicted taxonomy: Planctomycetes
  MG4-160 effector
MAAAKKPYILGLDLGVQSAGWAMIDVDDHGRPCGIRRSGVRCFDSGVGSETEIASGKDESQNIKRRQMRLQRRQLWRRGRRLKKVFLVLQKAGILPPGETRSPEQRHELLKLLDAELAKTHLPEHDRVAGHLLPYRLRALALDQALPPFAFGRALFHLAQRRGFLSIRKSASKDGDDEGAVKAGIAELQQNMQEAGVRTLGEYFSKLDPEAEKQRIRKRWTARSMYLDEFEKIWVAQSPHHPMLGEEWKTRVYDAIFHQRPLKSQKGLVGVCELEPTCRRAPRASVEAQRFRYLQKVNDLEIVTPDGEIWALTDPEHVDLRKKLIELLDTQAEVKFASLRSKLGLWAKLGRKKPKGTDKDFTFNLEAGGESKLKGNTTATKIRGVLGDDYGKLSPEQLAGLVDDLLEYEKKEALARRLTKNYEIAPAKADQLADVTLEPNYASLSREAMHKLLPIMENGRRFASLTQEELEKLFPNRRKGGITYDLLPPVLGIIDLRNPVVCRGLTELRKVLNALIRQYGKPELIRVELARDLKKSRQQREDLTKQNRDNEKARDAARTKIAERLHCDENAVSNLDILKVRLAEECNWECPYTGKSIAIEALVGKHAQFDIEHIIPFSRSLDNSFLNKTLCDNHFNRHVKKNGTPHETCSSNEREWQEIIGRVKRFRGSAAHAKLRKFQQEKPDEDFAARMLQDTRYMSRLATEYLGLLYGGTIDADHTRRVQVSAGRVTAYLRDEWGLNAILADGGEEEKNRDDHRHHAVDASVIALTNAGTVELLSHSAEVAAERGRRLFVREEIQQPWPTFLDDVRRAIEAINISYRVNRRVTGALHEETNYSKPHKSRDGNGNGKEVEYRHVRKPLQNMSANEVENIVDDIIRKLVQTKLDQIGGEPKKVFADPGNHPYLTAKDGRRIFIHKARIRKTVAVIPLGKSSSPRYAAPGSNHHMEIFATLDQEGKENRWESKIVSLFEAHRRVRAGEPVIQRDHGSNTEFKFSLAGGEYLELDDDGGGRRLVRITVISGKIAEFRLHTDARPITILRQTKGGRAGLSKPVDSLRKANARKVVVDPLGNILPAND

SEQ ID NO: 579 - protein, 780 aa, Unknown
  Description of Unknown: uncultivated organism with predicted taxonomy: Acidobacteriales bacterium 59-55
  MG4-161 effector
LETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 580 - protein, 792 aa, Unknown
  Description of Unknown: uncultivated organism
  MG4-162 effector
LHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIDLDRDLKKPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHRLTGALHDETNYGRPHKEGGKDVVHIRKQVVGMSAGDIENIVDPAVRESVREKAASFGGDLKKWTPKEGSEDWPLLRTKTGKEIPIKRVRIKKSLGVETIAKGDRARHVALSSNHHVAIFALLDERGGERRWEPMIVSLFEAMERKRKGQPLIQTRYPVVGEFIFKFSLMGGDTVLLHKDCDHKNNHCNPSVWRLRTIGSNGQLSLVRINDARLKAEIQKAKEWWS

SEQ ID NO: 581 - protein, 1106 aa, Unknown
  Description of Unknown: uncultivated organism with predicted taxonomy: Acidobacteriales bacterium 59-55
  MG4-163 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLSQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWRTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 582 - protein, 1015 aa, Unknown
  Description of Unknown: uncultivated organism
  MG4-164 effector
ARRVARLLRRQLRRRSARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKWTPKEGRGDWPQLGTKNGKQIPVKRVRIKKALSVETIGKDERTRHVALSSNHHVAIFAMLDKRGIEKRWKSIIVSLFEAMDRKRKGQPIVQTSYPEAGDYVFKFSLMGGDTVLLHKDCDHNQNPCNPSVWRLRSIAANGQLSLVRINDARPKSEIIKAKEWWSPIEDTLRELDAVKVVIDSLGRIHQAGG

SEQ ID NO: 583 - protein, 1062 aa, Unknown; identical to SEQ ID NO: 549
  Description of Unknown: uncultivated organism
  MG4-165 effector

SEQ ID NO: 584 - protein, 1076 aa, Unknown; identical to SEQ ID NO: 572
  Description of Unknown: uncultivated organism with predicted taxonomy: Candidatus Sulfotelmatomonas gaucii
  MG4-166 effector

SEQ ID NO: 585 - protein, 1105 aa, Unknown; identical to SEQ ID NO: 555
  Description of Unknown: uncultivated organism with predicted taxonomy: Acidobacteriales bacterium 59-55
  MG4-167 effector

SEQ ID NO: 586 - protein, 890 aa, Unknown
  Description of Unknown: uncultivated organism
  MG4-168 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKW

SEQ ID NO: 587 - protein, 1062 aa, Unknown; identical to SEQ ID NO: 575
  Description of Unknown: uncultivated organism
  MG4-169 effector

SEQ ID NO: 588 - protein, 1079 aa, Unknown; identical to SEQ ID NO: 544
  Description of Unknown: uncultivated organism
  MG4-170 effector

SEQ ID NO: 589 - protein, 902 aa, Unknown
  Description of Unknown: uncultivated organism
  MG4-171 effector
ILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 590 - protein, 1062 aa, Unknown
  Description of Unknown: uncultivated organism
  MG4-172 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 591 - protein, 766 aa, Unknown
  Description of Unknown: uncultivated organism with predicted taxonomy: Ignavibacteriales bacterium CG_4_9_14_3_um_filter_30_11
  MG4-173 effector
LRLRLDDGNERKLTPNERAVLLDLCEKREKLTIAKARSEIGISKGQKFTIEEGGEKNVPVNLTATRLRAALGQTWDGLTPLQKDDLVEDVGDGKRNPTDEGLERCGRDKWGLPQEIAEALGKVRLPDAYGRYSLRALVALLPAIEEGLTVEDAIRALYAGARKSAEPLPLLPPVRDEKMKTLLGEIRSPAVQRSLTELRKTVNAIIRRYGLPEKIHIELARDLKKSKKERQKQTEINRDREKLRQEATGELRKHDVVRFANPRNSDIEKYLLATEARWQCPYTSKKYGVTDVFGDHPQVDVEHIIPRSRSLDDSYLNKTLAYRSANMEKGNRTPREWLFESDQEQYDRMIGVVSGFDPRFEVGKKLRRFSMELSDPDSLLKEFTERQLQDTRYASKLACRYLGVLYGGTSDASGNQRVFASAGQVTAKLRRAWDLDRILSPDKPEKSRDDHRHHAIDALTVALSSTTLIRALATAAGEADRLFRRKIILPVPWVGFGEQARSAVENIQPSHRPMRKLSGPLHKETFYSRPRKHAVGTDRKGKPIEEECVHYRVPVTSLSSAKSFESIVDSRVRAAVEERAAQLGGGGNRFEKNWPELVTRKGQTVPIKRVRIRKVEGVVSIGKNGRERFVIPGSNHHAEILAELDANGRVKRYLCETVTMLEAVERKRQSVPVVNRDHGPGYKFHCTLSEGDLVEARGPGDEASRIWKVRTVRESQQLALTPALDARPKAVVQKDGMWSPSVNPLFRGGARKVLITPLGEVIPAND

SEQ ID NO: 592 - protein, 764 aa, Unknown
  Description of Unknown: uncultivated organism with predicted taxonomy: uncultured bacterium
  MG4-174 effector
MSDNGSLAQDYILGVDLGSASLGWAAIRQDENGMATRLLRAGVRIFDPAVSGDVEKGQDESNAVARRTARLIRRQLRRRAARQSELFRLLQTRGLLPSYQGSEADASQQRHTILNALDLKLAAKWAKSGSNEEQTAIELPLYLLRKTALDAALEPYELGRVFYHLSQRRGYRSNRKEQASGKEASGKAKKADDLGAVEGGIKELEEAMHPFRTLGEYFASLDPHIQKVRRRWTGRKMYEDEFAAIWAKQAAFHPDLLPEELHHQIKRLLFYQRPIKAQSNLIGGCELEPGERRAAWATLEAQQFRVLQKVNDLEIILPGNVTGIPLTPEQRKIVLDLLENSAEATFKKIRKALGLAENIGFNLQRGGDTRLKGNLTNTLMAEAFAERWPEMSNEEKMQAVEDWRTIEQKESLVRRAIEHWKLDETGAQWLAEKPAPNGYCMYSRKAIRKLLPLMATGTRFKAAEKEIYGNRLAGGKVYDRIPPVRDALKTLRNPAIERALTELRKVINALVHEHGKPAEVRIELARDLKKPRHERAKAVSYNRDREKQRTTAKEKMLREVGPGFQHPSRADVEKALLWEECQGECPYTGKRFPFSSLFGENPPLQVDHIIPFSRIPDDSFQNKTLCYHEENQHKGNRTPFEAYTDPAQYEAILNRVRSWRTPNPGKQRRFELRTLEELEGFSERQLNDTRYASKLACELVGTLYGGRDVPLKDGKSRQVVFASSGMVTSTLRKGWGLEAILREAAPSANGQNRGKPRTDHRHHA

SEQ ID NO: 593 - protein, 1079 aa, Unknown; identical to SEQ ID NO: 544
  Description of Unknown: uncultivated organism
  MG4-175 effector

SEQ ID NO: 594 - protein, 1062 aa, Unknown
  Description of Unknown: uncultivated organism with predicted taxonomy: Acidobacteriales bacterium 59-55
  MG4-176 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 595 - protein, 948 aa, Unknown
  Description of Unknown: uncultivated organism
  MG4-177 effector
MSFPDGVRQKYILGLDLGSASIGWAVIDLDGNLDPCGLLAAGSHIFDPGVEVPPAAGKMARDEAVFQGLDRSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDPWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHKLSGALHEATSYGKVRYYNAKGDPVRYQRIAIGKLL

SEQ ID NO: 596 - protein, 878 aa, Unknown
  Description of Unknown: uncultivated organism with predicted taxonomy: Acidobacteriales bacterium 59-55
  MG4-178 effector
KKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 597 - protein, 1106 aa, Unknown
  Description of Unknown: uncultivated organism with predicted taxonomy: Acidobacteria
  MG4-179 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 598 - protein, 1076 aa, Unknown; identical to SEQ ID NO: 545
  Description of Unknown: uncultivated organism
  MG4-180 effector

SEQ ID NO: 599 - protein, 1079 aa, Unknown; identical to SEQ ID NO: 544
  Description of Unknown: uncultivated organism
  MG4-181 effector

SEQ ID NO: 600 - protein, 1062 aa, Unknown; identical to SEQ ID NO: 549
  Description of Unknown: uncultivated organism
  MG4-182 effector

SEQ ID NO: 601 - protein, 766 aa, Unknown
  Description of Unknown: uncultivated organism
  MG4-183 effector
MSDNGSLAQDYILGVDLGSASLGWAAIRQDENGMATRLLRAGVRIFDPAVSGDVEKGQDESNAVARRTARLIRRQLRRRAARQSELFRLLQTRGLLPSYQGSEADASQQRHTILNALDLKLAAKWAKSGSNEEQTAIELPLYLLRKTALDAALEPYELGRVFYHLSQRRGYRSNRKEQASGKEASGKAKKADDLGAVEGGIKELEEAMHPFRTLGEYFASLDPHIQKVRRRWTGRKMYEDEFAAIWAKQAAFHPDLLPEELHHQIKRLLFYQRPIKAQSNLIGGCELEPGERRAAWATLEAQQFRVLQKVNDLEIILPGNVTGIPLTPEQRKIVLDLLENSAEATFKKIRKALGLAENIGFNLQRGGDTRLKGNLTNTLMAEAFAERWPEMSNEEKMQAVEDWRTIEQKESLVRRAIEHWKLDETGAQWLAEKPAPNGYCMYSRKAIRKLLPLMATGTRFKAAEKEIYGNRLAGGKVYDRIPPVRDALKTLRNPAIERALTELRKVINALVHEHGKPAEVRIELARDLKKPRHERAKAVSYNRDREKQRTTAKEKMLREVGPGFQHPSRADVEKALLWEECQGECPYTGKRFPFSSLFGENPPLQVDHIIPFSRIPDDSFQNKTLCYHEENQHKGNRTPFEAYTDPAQYEAILNRVRSWRTPNPGKQRRFELRTLEELEGFSERQLNDTRYASKLACELVGTLYGGRDVPLKDGKSRQVVFASSGMVTSTLRKGWGLEAILREAAPSANGQNRGKPRTDHRHHAID

SEQ ID NO: 602 - protein, 1076 aa, Unknown; identical to SEQ ID NO: 545
  Description of Unknown: uncultivated organism
  MG4-184 effector

SEQ ID NO: 603 - protein, 1062 aa, Unknown
  Description of Unknown: uncultivated organism
  MG4-185 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 604 - protein, 1079 aa, Unknown; identical to SEQ ID NO: 544
  Description of Unknown: uncultivated organism
  MG4-186 effector

SEQ ID NO: 605 - protein, 794 aa, Unknown
  Description of Unknown: uncultivated organism with predicted taxonomy: Polaribacter sp. ALD11
  MG4-187 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIEKDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQ

SEQ ID NO: 606 - protein, 1062 aa, Unknown
  Description of Unknown: uncultivated organism with predicted taxonomy: Acidobacteriales bacterium 59-55
  MG4-188 effector
MSAALEQQKYVLGLDLGSASLGWALIALNGADDPVSLIRAGVRIFEPGVDGTSMEIEQGKDQSKAVERRTARLHRRQLRRRAARQRDLFRVLQRHCLLPAPETLVGSPEEQRHSVLNELDQELTQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 607 - protein, 1106 aa, Unknown; identical to SEQ ID NO: 597
  Description of Unknown: uncultivated organism with predicted taxonomy: Polaribacter sp. ALD11
  MG4-189 effector

SEQ ID NO: 608 - protein, 1076 aa, Unknown; identical to SEQ ID NO: 545
  Description of Unknown: uncultivated organism
  MG4-190 effector

SEQ ID NO: 609 - protein, 1079 aa, Unknown; identical to SEQ ID NO: 544
  Description of Unknown: uncultivated organism
  MG4-191 effector

SEQ ID NO: 610 - protein, 983 aa, Unknown
  Description of Unknown: uncultivated organism
  MG4-192 effector
RRAARQRDLFRVLQRHCLLPAPETLVGSPEEQRHSVLNELDQELTQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 611 - protein, 1062 aa, Unknown; identical to SEQ ID NO: 549
  Description of Unknown: uncultivated organism with predicted taxonomy: Acidobacteriales bacterium 59-55
  MG4-193 effector

SEQ ID NO: 612 - protein, 1022 aa, Unknown
  Description of Unknown: uncultivated organism
  MG4-194 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKWTPKEGRGDWPQLGTKNGKQIPVKRVRIKKALSVETIGKDERTRHVALSSNHHVAIFAMLDKRGIEKRWKSIIVSLFEAMDRKRKGQPIVQTSYPEAGDYVFKFSLMGGDTVLLHKDCDHNQNPCNPSVWRLR

SEQ ID NO: 613 - protein, 1062 aa, Unknown; identical to SEQ ID NO: 594
  Description of Unknown: uncultivated organism
  MG4-195 effector

SEQ ID NO: 614 - protein, 862 aa, Unknown
  Description of Unknown: uncultivated organism with predicted taxonomy: Acidobacteriales bacterium 59-55
  MG4-196 effector
DKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 615 - protein, 1062 aa, Unknown
  Description of Unknown: uncultivated organism
  MG4-197 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 616 - protein, 1084 aa, Unknown
  Description of Unknown: uncultivated organism
  MG4-198 effector
MSAKSEELKGAPYILGLDLGAASLGWAVVGLADGKPACHVDGGVRIFPEAVENLEQGKDDPKSAQRRLARQMRRQTDRRARRVASVFRVLQKAGLLPRFSEGADPADPLARHELINRLDEDLACTVPGLIDPAAEHRSRSVFHYRLRALAIHQDLPPYAIGRAFLHIAQRRGFKSGRIEEASGSEKAKERESDSRKERRQVAARIESLPAEFLRLGACTIGEYWSKLDPNQKRIRGIGNWSGRQMHVDEFDRIWERQAPRQQEIMTPLLYRIVKRRIFFQRPLKSAAGLIGHCELERESQRRRAPLAHPLYQRFRILQTVNDLRIVEGSGLSRPLTVEQRIKALDTLSRQQTVTFKSLHKKLGLVPGETFSHEEGDRKDLPGNRTECKLREVFGEQWDSLPEQQKNVIAGYVRSMDDSAVLARIAETRWGLGHLRAARLAGIQLEQGYGRLSVAALRKLLPLMEEGLPYMTAVERIYPDRAFAPTQELLPKVLDLKNVRNPAVVRALTELRKVVNGVIREYGRPERIQIELARELKKPAKARERIAQENRQREDLRKKTIERIFRECGLGKPSNADIEKAILWEECQHHDPYTGGSINFHDLFGSDAKWEIEHIIPHSRSQDDSLTNKTLCSRETNRQKGNRTPFEVFGNTPEWEAMVERVTKFQGDKRAMTRKLARFTMEGGVEELFGEFTQRQLNDTKYASLLAMEFLGQLYGGVCDERGIRRVNAVSGGVTAQIRKGWRLHSILRDGPSQGEAKPRDDHRHHAIDALVIAMTDAGAVQAVSRASERSRLDHRHGFRVDDPWNGFLEQVQAVIRAIRVSHRPDHHLRGALHAESLYSPPRSERGAAPRHRIRKWLSSLTPEQVRDIVDTKVREAVEAKLKELGQTDPRDAFKNNADPPTLGNRHGDPVPIRRVRVYVSVSPQRIGTGATARHVVSKDNHHLAIYRLSADKKGTARWTGEAVSLLEALKRMNLPGRPVIAPVNESGAPLVMALYKGDLVEMTVPKSQPPERDLFVVRGFSIEKRGGPEINFVRHNLAAEIADLKDAGEWQRIRSWDELRLLNPRIVRLGAMGRVMPDDSQPNS

SEQ ID NO: 617 - protein, 1079 aa, Unknown; identical to SEQ ID NO: 544
  Description of Unknown: uncultivated organism
  MG4-199 effector

SEQ ID NO: 618 - protein, 1079 aa, Unknown; identical to SEQ ID NO: 544
  Description of Unknown: uncultivated organism
  MG4-200 effector

SEQ ID NO: 619 - protein, 1106 aa, Unknown
  Description of Unknown: uncultivated organism with predicted taxonomy: Acidobacteriales bacterium 59-55
  MG4-201 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTSPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 620 - protein, 1062 aa, Unknown; identical to SEQ ID NO: 549
  Description of Unknown: uncultivated organism with predicted taxonomy: Acidobacteriales bacterium 59-55
  MG4-202 effector

SEQ ID NO: 621 - protein, 1062 aa, Unknown
  Description of Unknown: uncultivated organism with predicted taxonomy: Acidobacteriales bacterium 59-55
  MG4-203 effector
MSSALEQQKYVLGLDLGSASLGWALIALNGADDPVSLIRAGVRIFEPGVDGTSMEIEQGKDQSKAVERRTARLHRRQLRRRAARQMDLFRVLQRHFLLPSPETLFGSPEEQMHSVLNELDQELTQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 622 - protein, 830 aa, Unknown
  Description of Unknown: uncultivated organism with predicted taxonomy: Acidobacteriales bacterium 59-55
  MG4-204 effector
MFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 623 - protein, 819 aa, Unknown
  Description of Unknown: uncultivated organism with predicted taxonomy: Acidobacteria
  MG4-205 effector
MAAIAPPSFRPGLVLGIDLGSNSLGTALIRTDLDLIEFMGVRIFPAGVEGNLEEGKEESRAAKRRQARLARRQTQRRQRRLYKVFHFLQRIGLLPTGDRLEVLGRLQNELEHCYPQTTVLPWFLRARALDQALGPHELGLALYHLAQRRGFLSNRAGGKDNEKERSEVKASIKGLAAAIEAAGKRTLGEYMASLNPREKLRNSAEFSGHYTHRSMFEREFDMIWDSQKAHHPEILTENHGAKLHDAMFHQRPLKDQSYLVGQCELEPTEKRAPLRLLAAQRFRILGFVNNLRLRLEDGNERKLTPNERAVLLDLCEKAEKLSLAAARRVLGLSTAQRFTIEEGGEKNVPVNLTATRLRAALGQAWDGLTAAQKDDLIEDVGDGKRCPTDEDLERCGREKWGWPQEVANALSKVRLPDGYGRYSLRALVALLPALEGGITVEEAIRAIPAYAETRNAAEPLPMLPPVRDLKAMLGEIRNPAVLRSLTELRKTVNAIIRRYGIPEQIHIELARDLKKSKKERQYQAELNREREKMRQEATEELRKYDAVRFANPRNTDIEKYLLAKEARWQCPYTNKKYGFTDVFGDHPQVDVEHIIPRSRSLDDSYVNKTLAYRSANAEKGNRTPREWLFESDQEQYEQMIRVVKQFDPRFEVGKKLRRFSMELSDPDSLLREFTERQLQDTRYASKLACRYLGVLYGGTIDASGKRRVFASAGQVTAKLRRAWDLDRILSPDKPEKCRDDHRHHAIDALTVALSSTTLIRELARAAGEADRLFRRKIILPVPWVGFGEQTRSAVERIQPSHRPMRKLAGPLHEETFYSR

SEQ ID NO: 624 - protein, 1062 aa, Unknown
  Description of Unknown: uncultivated organism
  MG4-206 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 625 - protein, 1056 aa, Unknown
  Description of Unknown: uncultivated organism
  MG4-207 effector
MAAIAPPSFRPGLVLGIDLGSNSLGTALIRTDLDLIEFMGVRIFPAGVEGNLEEGKEESRAAKRRQARLARRQTQRRQRRLYKVFHFLQRIGLLPTGDRLEVLGRLQNELEHCYPQTTVLPWFLRARALDQALGPHELGLALYHLAQRRGFLSNRAGGKDNEKERSEVKASIKGLAAAIEAAGKRTLGEYMASLNPREKLRNSAEFSGHYTHRSMFEREFDMIWDSQKAHHPEILTENHGAKLHDAMFHQRPLKDQSYLVGQCELEPTEKRAPLRLLAAQRFRILGFVNNLRLRLEDGNERKLTPNERAVLLDLCEKAEKLSLAAARRVLGLSTAQRFTIEEGGEKNVPVNLTATRLRAALGQAWDGLTAAQKDDLIEDVGDGKRCPTDEDLERCGREKWGWPQEVANALSKVRLPDGYGRYSLRALVALLPALEGGITVEEAIRAIPAYAETRNAAEPLPMLPPVRDLKAMLGEIRNPAVLRSLTELRKTVNAIIRRYGIPEQIHIELARDLKKSKKERQYQAELNREREKMRQEATEELRKYDAVRFANPRNTDIEKYLLAKEARWQCPYTNKKYGFTDVFGDHPQVDVEHIIPRSRSLDDSYVNKTLAYRSANAEKGNRTPREWLFESDQEQYEQMIRVVKQFDPRFEVGKKLRRFSMELSDPDSLLREFTERQLQDTRYASKLACRYLGVLYGGTIDASGKRRVFASAGQVTAKLRRAWDLDRILSPDKPEKCRDDHRHHAIDALTVALSSTTLIRELARAAGEADRLFRRKIILPVPWVGFGEQTRSAVERIQPSHRPMRKLAGPLHEETFYSRPRKEAVGTDKKGNPIKKEFVHYRVPVTSLASAKDFESIVDSHVRAAVKEKAAQLGGGGNKFEKNWPALVTRKGQTVPIRRVRIRKVQSVVSIGKDERKRFVVPGSNHHAEILKELDANGRVKRYLCETVTMLKALERKRQGVPVVSRDHGPGYKFHCTLSEGDLVEARGPGDEALRIWKVRTVRDSQQLALTPALDARPKADVQKDGMWSPRVNSLFLGGARKVLITPLGEVIPAND

SEQ ID NO: 626 - protein, 1076 aa, Unknown; identical to SEQ ID NO: 545
  Description of Unknown: uncultivated organism
  MG4-208 effector

SEQ ID NO: 627 - protein, 1079 aa, Unknown; identical to SEQ ID NO: 544
  Description of Unknown: uncultivated organism
  MG4-209 effector

SEQ ID NO: 628 - protein, 827 aa, Unknown
  Description of Unknown: uncultivated organism with predicted taxonomy: candidate division Kazan bacterium
  MG4-210 effector
QMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSH

SEQ ID NO: 629 - protein, 845 aa, Unknown
  Description of Unknown: uncultivated organism with predicted taxonomy: Acidobacteriales bacterium 59-55
  MG4-211 effector
RIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 630 - protein, 1076 aa, Unknown; identical to SEQ ID NO: 545
  Description of Unknown: uncultivated organism
  MG4-212 effector

SEQ ID NO: 631 - protein, 1106 aa, Unknown; identical to SEQ ID NO: 597
  Description of Unknown: uncultivated organism with predicted taxonomy: Polaribacter sp. ALD11
  MG4-213 effector

SEQ ID NO: 632 - protein, 1079 aa, Unknown; identical to SEQ ID NO: 544
  Description of Unknown: uncultivated organism
  MG4-214 effector

SEQ ID NO: 633 - protein, 1109 aa, Unknown
  Description of Unknown: uncultivated organism
  MG4-215 effector
RSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHKLSGALHEATSYGKVRYYNAKGDPVRYQRIAIGKLLTDKQIEKIVDEEVKKSVVKLGETIGGYKKWSQEKHGWPKMPNRNGEPVPIKKVRIKITKNAKEIEAERFRGFGTGRPESNVEDKEIAYASFFTVQDRKGTKTVWEIVKLFEAAQRVRALPKSERGHEKICWKYPKYPDATFFRFSLMKGDLVELVLNGKPAIFIVRRFEFDSRLWVAPINAAGKDEEMEAAGHLLRLGFSRFLTMGAGDDKIPRPVFVDLLGQPHYINIGA

SEQ ID NO: 634 - protein, 1062 aa, Unknown
  Description of Unknown: uncultivated organism
  MG4-216 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 635 - protein, 754 aa, Unknown
  Description of Unknown: uncultivated organism with predicted taxonomy: candidate division Zixibacteria bacterium CG_4_9_14_3_um_filter_46_8
  MG4-217 effector
LSENTPRIAEDLILGLDLGTNSLGWCLLSAPEGNPASIVAIGVRSFDAGGDISAANGKSPCVIRREARVARRVVARRAKRLRDALRALQAAGLLPAGKAKDVIPPLDAAWLEERLSSFPQRDPERLRQAHLLPYLLRKEALDRPLTRQELGRALYHLAQRRGFLTNRKAEPKKDEKPGEVKQSIDSLRGKMEQAHARTLGEYFAGLDPQETRIRRRWTARGMYLDEFECIWTAQAPHHAEVLTSALKADLYRAIFRKRPMSSAASLVGPCAHEPNRRRAPACILPAQRFRLLQQVINCRVIEPNQVGRLLTDEEFAKLVQALEERDEMTVTEAKKVLGLPSRSKFTFEEGGEKKFNGNGTNAGLANVFGPAWETFTPDQRDAVVTEVRSFEDPEALIRRATSGRAFWNLDAQAGKALADVRLQQGYCALSRRALERLLPLMESRVPYQTAVEQIYKESCRKTAVKDLLPRVSELKELRNPVVSRVLTETRKVVNAIIRKYGIPGRVRIELGRDLKQSKDHRLRATKNARDNEESRKAAIRKILAETPVRSPGPDDILRAQLYEECNHECPYTGRKIAFAALFGDSPQFDIEHIIPFSRCLDDSFANKTLCYHEVNRHVKGNRTPLEAFGSTPEWERIVQSVRLFSGKAAEGKLRRFLMTEEEILKLQDFANSQLSDTRYASKLAMRYLALLYGGLSDEGGTQRIQAGSGNVTKHVRQAHRLNGILGDGPGKNRNDHRHHAVDALAIALTDQALV

SEQ ID NO: 636 - protein, 1045 aa, Unknown
  Description of Unknown: uncultivated organism with predicted taxonomy: Planctomicrobium piriforme
  MG4-218 effector
MANPTGVPYILGLDIGASSIGWALLAANTDRSERLLRCGARVFDAGMEEGDFSAGKENSRSAVRRLARQARKLTSRRMRRQRKLFNLLVKAGLLPAGEPSQVVPALDADLRRKHVAMLPKGSDARRQAEHVLPYRLRALALDQKLEALELGRAIYHLAQRRGFLSNRKAPPRKDEKPGEVKEHITELEKNIKAAGARTLGKYLSGLDPEQERIRRRWTSRPMYLDEFAVLWAAQAAYHPAILTDDLRKRIHRAIFHQRPLKNQSNLIGTCELERGRQRAPKALLLFQRFRTLQQITSARVVARSGAGRELGAAERATLLAALDRQGELAFSKAKKLIGLPPGSTFNWESGGEDKFNGNHTGARLAEIFGDRWHRMCPSGKDQVVEDVLSIHSDAALERRGLKWDLDSEAAARFGHVNLEDGHGGLSRQALQKLVPLMEQGVPYATAVDKVYGRKEHKPLEVLPPPAPTYPHLRNPMVLRVLAELRKVVNAVIAAHGKPDAVRVELARDMRRSKKQRQESWLRMRQNERDRKRAAQKILAEMNNDSPSRQDKEKVLLAEECNWTCPYTGKCISMQSLLGPTPQFDIEHIIPFSRSLDDSFTNKTLCDIAENRDHKRNRTPFEAYAAEPDKWNAILGRVGRFRSNAREEKVRRFRQEEIEGIEDFAARQLNDTRYATRQATDYLALLYGGLYEKGGKRFIQAAKGGTTAYLRNEWQLNSILGDGGTKSRDDHRHHAVDAVAIALTDAGTVKMLSDAAGRAAQEGRRRFGRVEDPWPGFLDDVRQAIEGLNVSHRVSRKVNGPLHEETNYGPGKKRDAAGRPESLSVRKRLDALTPADMKLIADERVRGLVTAKLATLGGDAKKAFSDVKNHPCFELKDGRRIPIHAVRLRRSGTALAVGEGARVRYVLTGSNHHMELYEVTDAKGKTRWKGRVVSRFEAIRRQGRKQPVVDRTPPDGGTFKFSLAPGEIVHLTDEKGEARLYRVRTVSQAASGSIEIAGAKVNDARLKDEIIKGGDWLRITSMDKVAAMSCHKVIITPLGEIRDAND

SEQ ID NO: 637 - protein, 1076 aa, Unknown
  Description of Unknown: uncultivated organism with predicted taxonomy: Candidatus Sulfotelmatomonas gaucii
  MG4-219 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPETLGGSPEEQRHSILNGLDQALARKWQSAFPDNRFAQLPLYYLRKRALDEPLEAHEIGRILFHLIQRRGFLSNRRENKQNPDQKKELGQVKAEIHSLEQEIQNAGARTLGEFFAGLDPHAQKVRRRWTARKMFQNEFEKIWEAQVIHCPNLLMPELHDKIAHLLFFQRPIATQSHLVGKCELEPGKQRAPWAAMEAQRFRILQKVNDLRLVNPGSLISDPLTEEDRQRLNSLLDREGDQTFKAIKKYLSFPADVQFNLEKGDEKRLRGNRTQAAMRKVFGDRWDRMSAGKQHQIVENWRNSESDEALIREAEEQWSLDDTAATLLSEQIPEPGYCAVSLTAISKLLPLMQCGKSFKEAETVVYGARFSGGVVFDTLPEVRKQLESLRNPAVERALTELRKVVNAIVREYGKPYEIRIELARELKKPRQERLEATKKNRTRQREREDIAGKILRECGLSNPSRKDIEKARLHEECGGICPYTGRHIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTATLRSSWGLEAILHEIVPAESGESRGKPRTDHRHHAIDAITIALTRSKVIQSMARTASLEPWQIDSRAWRKIELPWRDFVPSIRPHIEQMLVSHRPEHKMSGELHKGTNYSTPYNYKGKPTVHTRCLLSALSAADIAGDEVIVDTAVRDAVRKKLAELGGNPKLFDRPENAPCLSARDGRLIPIRKVRVRETKNPVKVGKGVRERFTSSGGIHHVALFVTRDEKRREKWDSEVAQVTEIYRRCPRNDHRKGRSQPVVTESPISRQLKSDPEAQFLFSVMKDDTIEVTDPNGIHILRVKKFSDNKQMWFVPVNDAHDDTQQMKLGITWSKTPNSLKELRPRKVVVDLLGKVHPAND

SEQ ID NO: 638 - protein, 1068 aa, Unknown
  Description of Unknown: uncultivated organism with predicted taxonomy: Proteobacteria
  MG4-220 effector
MSTALVPSDYILGIDLGSNSIGWAMIGLDQGKPTGLIRAGARVFDAGMEGDLESGQEESRNVARRDARMQRRQMARRARRLTKIFHILQRIGLLPPADLKTPEQRQEFLNQLDSNIIGSDWFKTKRAGNNFGEIDQVMPYLLRAAALDEPLDPHQLGRALYHLGQRRGFLSNRKKPMKKGEDEGVVKESIAELRQKMQESGARTLGEYFMRINPFERRIRQRWTHRDMYEGEFEKIWEAQAAHHPLLLTPERKKELKRAIFYQRPLRFPRELVGHCELEPEEIRAPRHYFIAQRFRLLQSLNNLRVAMPGEAERDLTAEERAKLDNELELHGDRTFGQIRKLLGIKRATFNLESGGEKLLRGNRTTAQFYKVFGERWLEMSSVEHEQALQDVRSIVKDETRLRRGSEHWKLDPEHAREFAAISLEPDYFNLSRKAMERLLPLLETGVSYATARRQLYPERFQAREPVPLLPPLHDVFEYLRNPAVERSLTELRKVVNALVRQYGKPAQIRLELARDLRKSRKEREANWKKNRDIEKSRKIMAERITAEAGITDPSREDIRKALLAKECGWVCPYTGRAISMRALVGPDAQFDIEHIIPFSQSLDNSFFNVTLCYHEENRNRKRNQTPYGAYGNEPEKFQEILDRVRRFDSDLADEKLKRFQLTDTADILKGFVDRQLNDTRYASTMAGDYLGFLYGGKIDSQRNLRVRATTGQVTAYLRDEWMLNRILRDGPTEQGGKVAKSREDHRHHAVDAIAIALTDESTIQQLSRAAQQAPQLGRRRFAPVQAPWPDFVDSVRAEIGRIVVSHRPNRKVSGALHEETLYSKSMPVPDSLKSQEKAPRVRKPLERLSKSEVEDIADPIVREMVQKKLEQLDGDPKKFSVAANLPFFKTADGREIPIKSVRVIKKTPTFPLGMGSRMRNVTSESNHHLEIFAELDEHGEEVEWDGVVVPMAEAYKRLAEAKRLRTKVPIVQRDFGAHRHFKFSLAAGDVVQCDNNHEGRRLLVVRGTSIEGGKTGRVALVPINDARKKNEIVASKDYFRFPLEKLRKLHTCKVTLSPLGDLGTAND

SEQ ID NO: 639 - protein, 876 aa, Unknown
  Description of Unknown: uncultivated organism with predicted taxonomy: Acidobacteriales bacterium 59-55
  MG4-221 effector
TGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 640 - protein, 1062 aa, Unknown
  Description of Unknown: uncultivated organism
  MG4-222 effector
MSSALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 641 - protein, 1079 aa, Unknown; identical to SEQ ID NO: 544
  Description of Unknown: uncultivated organism
  MG4-223 effector

SEQ ID NO: 642 - protein, 1076 aa, Unknown; identical to SEQ ID NO: 545
  Description of Unknown: uncultivated organism
  MG4-224 effector

SEQ ID NO: 643 - protein, 1179 aa, Unknown
  Description of Unknown: uncultivated organism
  MG4-225 effector
MSFPDGVRQKYILGLDLGSASIGWAVIDLDGNLDPCGLLAAGSHIFDPGVEVPPAAGKMARDEAVFQGLDRSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKNNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTLYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHKLSGALHEATSYGKVRYYNAKGDPVRYQRIAIGKLLTDKQIEKIVDEEVKKSVVKLGETIGGYKKWSQEKHGWPKMPNRNGEPVPIKKVRIKITKNAKEIEAERFRGFGTGRPESNVEDKEIAYASFFTVQDRKGTKTVWEIVKLFEAAQRVRALPKSERGHEKICWKYPKYPDATFFRFSLMKGDLVELVLNGKPAIFIVRRFEFDSRLWVAPINAAGKDEEMEAAGHLLRLGFSRFLTMGAGDDKIPRPVFVDLLGQPHYINIGA

SEQ ID NO: 644 - protein, 794 aa, Unknown
  Description of Unknown: uncultivated organism with predicted taxonomy: Polaribacter sp. ALD11
  MG4-226 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQNEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQ

SEQ ID NO: 645 - protein, 1079 aa, Unknown; identical to SEQ ID NO: 544
  Description of Unknown: uncultivated organism
  MG4-227 effector

SEQ ID NO: 646 - protein, 1059 aa, Unknown
  Description of Unknown: uncultivated organism
  MG4-247 effector
MKVKQESPQLILGLDIGTNSIGWSLLEDKGQDQGRIVGSGVRVYEAGMEGLIEQGKEESRNKNRRDARLHRRNLQRRARRMGGLWSLLQSSGLLPEGKAEGVLPELDKGLSETWTKKLGLDTKDKVGEKTQFSHVFPYFLRARALDEKLSCHELGRALYHLAQRRGFLSNRKAAPKKKEEEKGMKAEISELGRKIEESEARTLGEYFSRLNPEEGRIRSKHTSRKMYQEEFEAIWNAQTPHYPTILTEELKKKVSHAIFYQRPLKIRKEFIGNCEHEHNPDHPDRSPRRAPWALLDAQRFRLLQKVNDLVLTDTSTGEVRKLTPDERTKLLEALETQGDLTFGKIRKLTGLRKARFNFEAGGNDKLPGNRTASKLIKIFGEEKWKEFSTEQREQIVEDVHSIQSEEAQARRGIRAWGLEGEKAKDFGQLALEDGYCNLSRQALAKLLPRMEKGTAYKTAVKEVYGEPPAEKPLDSLPLVTEHLSSLRNPAVTRTLTELRKVVNNVVRQYGKPNMTRIELARDLKKSKKDREDIWKRNRENEKAREEAAKKILAEIPNLKPSRRDKEKVLLYEECGHKCPYTGKQISMASLLGDHPQFDIEHIIPFPRSLDDSFLNKTLCYAEENRNVKQGKTPHEAYGSNPTRWEEIIQRVKDFKGKARDIKLERFEAHGEKLDKLLGEFANRQLPDTAYASRLAVEYLGRLYGGRGGVDADGNRRVQAGRGQVTAYLRNEWGLNKILNDGGEKSRDDHRHHAVDAICVALTDAGTVKMLSDAASRATIERRRRFGKVNPPWPTFLDDVRKSIEGLIVSHRVSRKVSGPLHKGTNYSKPIRGTDKKGNPCEFRRVRKPLAELSEPEIKDVADPTIRQLVLDKLQALGVKEPKKAFSSNEANHPCLTTKDGREIPIHKVRINKKVTPFTVGEGLRQRHVTTESNHHIEVVEVLDKNGKPKWEGCLVSLKDAYDRLKAGLPVVKLDHGEGRRFVFSLAKGEAIKIDEENGGNRGLYVVKKLGDNRIWFVDTREARKLKEAGYNSKLMEPLRTLNCQKVLITPLGEVRRAND

SEQ ID NO: 647 - protein, 1014 aa, Unknown
  Description of Unknown: uncultivated organism with predicted taxonomy: Planctomycetes
  MG4-248 effector
MKVKQESPQLILGLDIGTNSIGWSLLEDKGQDQGRIVGSGVRVYEAGMEGLIEQGKEESRNKNRRDARLHRRNLQRRARRMGGLWSLLQSSGLLPEGKAEGVLPELDKGLSETWTKKLGLDTKDKVGEKTQFSHVFPYFLRARALDEKLSCHELGRALYHLAQRRGFLSNRKAAPKKKEEEKGMKAEISELGRKIEESEARTLGEYFSRLNPEEGRIRSKHTSRKMYQEEFEAIWNAQTPHYPTILTEELKKKVSHAIFYQRPLKIRKEFIGNCEHEHNPDHPDRSPRRAPWALLDAQRFRLLQKVNDLVLTDTSTGEVRKLTPDERTKLLEALETQGDLTFGKIRKLTGLRKARFNFEAGGNDKLPGNRTASKLIKIFGEEKWKEFSTEQREQIVEDVHSIQSEEAQARRGIRAWGLEGEKAKDFGQLALEDGYCNLSRQALAKLLPRMEKGTAYKTAVKEVYGEPPAEKPLDSLPLVTEHLSSLRNPAVTRTLTELRKVVNNVVRQYGKPNMTRIELARDLKKSKKDREDIWKRNRENEKAREEAAKKILAEIPNLKPSRRDKEKVLLYEECGHKCPYTGKQISMASLLGDHPQFDIEHIIPFPRSLDDSFLNKTLCYAEENRNVKQGKTPHEAYGSNPTRWEEIIQRVKDFKGKARDIKLERFEAHGEKLDKLLGEFANRQLPDTAYASRLAVEYLGRLYGGRGGVDADGNRRVQAGRGQVTAYLRNEWGLNKILNDGGEKSRDDHRHHAVDAICVALTDAGTVKMLSDAASRATIERRRRFGKVNPPWPTFLDDVRKSIEGLIVSHRVSRKVSGPLHKGTNYSKPIRGTDKKGNPCEFRRVRKPLAELSEPEIKDVADPTIRQLVLDKLQALGVKEPKKAFSSNEANHPCLTTKDGREIPIHKVRINKKVTPFTVGEGLRQRHVTTESNHHIEVVEVLDKNGKPKWEGCLVSLKDAYDRLKAGLPVVKLDHGEGRRFVFSLAKGEAIKIDEENGGNRGLYVVKKLGDNRI

SEQ ID NO: 648 - protein, 1134 aa, Unknown
  Description of Unknown: uncultivated organism with predicted taxonomy: Fuerstia marisgermanicae
  MG4-249 effector
MADQLEQKPFILGIDLGTNSVGWALIRLEDGKPAGIIRAGARVFDAGMEGSAKDFESGGEKSRNLDRRRMRHQRRQTWRRARRMKKIFGLLQKFGLLPEGRCATPEDRQNFINELDRTIRASPWFQKKHPVCSKQNSELTKDEREEAHRLSQLLPYILRASALSEKLEPYILGRALYNLAQRRGFQSNRKQVAGKKEEDEEKGKVKPAIKALESKIEEQEARTLGSLLSGASPLKERIRGPQRWTGREMFRNEFDEIWKAQSHFHPELLTEDKRNELFDKDYPRHDPRVGAVFYQRPLKIQTHLVGFCELEPNLRRAPIHLLSSQRFRLLQKVNDLRIELPDSGERPLTPEERDKLVRILQDEGNQTVSDVKSKGVLNLRGCTFTLERNREKTIPGNRTAASFRKALGEKWEDMGSEERNDLVAKVYDIDDDESLKKAAVEQWHFTPQEAERLAQIKFEAKYLNLSETAVERLLPLMEIGFSYGSLAPYYSHLSSQEFLAKLFSALEEGVPHAEACRMVFGDLPVPAEAPKDVLPPVVEAFREIRNPAVTRSLTELRKVVNAIVRRYDKPAEIRIELGRELKKPKKRRELISKRNDENRSERETARREITEETGDPYPGKTDIRKVLLRRECGDQCVYCGEQFSGSNFFSDDAPIEIDHIIPRSLHWDDSFLNLALCHAKCNREKGDNTPAQVFSDEVIEQIRDRIRRFSGNEKTKRERFRRFTLAGAELSAYLEEFSRRQLQDTAYASKLAKRYLGLLYGGEIDNLGKRRVTATSGMVTWDLRGGWDLNGILNDGRTSNGSTVVKTRDDHRHHAVDAVVIALTDDRSIQQLNKAAAMGQMQGKRGIIKLPSTWNNFVDTVRAEIGRIIVSHRVSKKVSGALHEETIYSPPIAERGPDGKPNGEAVPHVRKPLFAITKGEIENIADDAVRQRVIARLEELGGGDPKKLFATEANLPFLVTRDGRHIPIKKVRVRKQLSPLVLGAGRVARHVVTEVNHHLEVFAYLDEKGNEYEWDGAVVSMAEAYRRTYSKPPLPPVQRNHGPETQYKFSLSPGEIIQCDPDNKGNSKLLVVRSVSQFETGTVQIGLAEINDARKKSDMTKDRKFIRVVPNKLRQWNARKVAVSPLGEVSEAND

SEQ ID NO: 649 - protein, 1097 aa, Unknown
  Description of Unknown: uncultivated organism
  MG4-250 effector
MADQLEQKPFVLGIDLGSNSVGWALIRLEDGKPAGIIRAGARAFDAGMKGSIESGREESRNVKRRQMRLQQRQTWRRARRLKKIFRLLQEFKLLPDGEASTPDKRQDLLEALDKNILASAWFKQKESAGSKHEARQVLPYLLRAAALDEKLEPHYLGRALYHLAQRRGFKSNRIQSSVKKKEDDEGPVKQEIKSLGNRMGEATLGQYFSGLSPFVQRIRTQKTLRDWYRKEFDLIWDKQAQHHPELQMTEKKKEELFHAIFDQRPLKDQSHLIGPCELEPGERRAPTYLLSSQRFRLLQKVNDLRVRVPEGSELELLAEDRTKLIQALEEKGNQTFVQVAKKLKLGEPEFNLQRGGEKKLPGDRTGSQFRKVFRKSWDQMTDEERDEKVSVVYDCLDDQKLVGIGEKEWSLDAKFAAKLTEIKFESSYLNLSRAAIGKLLTLMEAGFSYGSLAPFYRHLTPETTASLLSKVQEGMPPKLASQVVFAECINPAGEPKSLLPPVAMEIPWLRNPTVMRSLTELRKVVNAIIRQYGKKPEEIRIELAREMKKPKWRRKQISKRNRENETGRKQAKEEIKRETQNPYPSPYDIRKLILYKECRGQCVYCGAQISRSNLFGDNSDSEVDHIIPFSRLQEDSFTHVVLCHARCNAEKGNRTPSEAFTGEEHERILDRVSRFDNDEATRKAKLRHFTLAGEELANYLNDFSSRQLNDTAYASKLACQYLGVLYGGVEDSTGKKRVKASSGGVTGYLRRLWNLNRILNDGPTKSGGFIPKTRDDHRHHAVDAVVIGLTDESVVHKLSRAAERGFYRGRPFAPLEGLWPNFVPSIKTEIDRVVVSHRVSKKVSGALHEETIYSPSIPERGPDGKPNGEGIPHVRKPLAAITKGEIKDIADDAVRQRVQKRLQELGDGDPKKLFAIEANLPFLIAKDGRHIPIKRVRVKKKLPTFPLGSGRAERNVTTESNHHLEIFSKLDEDGNEVGWDGAVVSMLKVYSRKRLGLPIVQREHGPGTQFKFSLGAGEVVECDIAPGQRGLFVFRKVSRITATDQIQIGFAPLNDARKAKDMQTSRSWLWSGPNRLMERHARKFVVNPLGEVSEAHD

SEQ ID NO: 650 - protein, 1024 aa, Unknown
  Description of Unknown: uncultivated organism
  MG4-251 effector
MGLTTLGIDLGITSIGWGLITEDAAGIKLNGWGSRIFTPGMDDDIESGKGVSRCAQRRQKRALRIQYRRRRQRKDDLVDLLQRNDLLPTPLTPGFFIDMDKRFLMLFPVAERRVMGHLVPYLYRKKALDTKLEKFELGRTIFHLAQRRGYLSNRKQDLKDEETTGVVKAGIDALKSEMRKVGARTLGEYFCTVDPEKSRIRTRYTDRGMFQEEFRLICSAQRHLISPELEDELYKAIFFQRKLRSAKNLIGRCQIYPEERRCSYAKDEAQRFRIYSTLNHLRVAQKQQIRALTEAERAAAISVLEGFSGHLDRRGKITLAKLAKAVGLGKGEKFTLSDEEKDIHGNVLNAILYHVFGEKASSLTEKERALFFNDLNSIEKTEVLERRLRGFWQLPEDKAAEALKISLPDEYCAYSLRALHEMLPDLEAGIPLSQIRKLSYPTSTGVVYDRLPMLDGDEVDLDLRNPVVHRTLTELRAVVNAVIAKYGKPDRIRVELARDLKSSNKERERRTFEIRKREKARAEIAERIAREAQIEKPSRNDILKVMLADECNFTCPYTGKNFSMKELLYGKDIQIEHIIPYSRSFDDSFRNKTLCFSSANAKKNNRTPFEAFSGAEYEEILQRVGKFKWPFAEDKKDLFKCEKVDSEEFLARNLNDTRYASRLAVKYLGMLYGGVIDAAGKQRVFATTGGATAIVRRAWGANFLLGEGEKVRDDHRHHAIDALTIALTTPDIVKIIAGMPEELRRAKGKTPDDTIIDNAVFKQAKEMLDKAAVSHHIVNKLRGALHRETLYGKNRGGDMRHVRIGVDKLTVKDIPDIVDPVIKKLILERLEIDEDQISTITDKLLKKLVDTENPLFYRNKKGDVVNEIKAVRVKKHVTARTIGAGDGVREVANGANYLLAVFAVQDAQGNESSWEGEIVTLMDAVYRKQHDLPLFERERPGRKFKFTLKKGDIVKWNKDGVEQLCVIRGVSLPQFSCVPVCDARQQKELKNAKCWFTPTLSAAFAGKMTKYRMDILGELRRAND

SEQ ID NO: 651 - protein, 1033 aa, Unknown
  Description of Unknown: uncultivated organism with predicted taxonomy: Bdellovibrio exovorus
  MG4-252 effector
MRILGLDLGITSIGWALTEQPSASVTDVSEIKLVDWGSRIFEPGMAGTKNDIDTGKGVSRAVERRLARSLRHQYQRRRQRRKELIRIMTEAGFLPQELTPAFFIRMDAKLLSAFPKEDRRILGHVIPYLYRKMALNQDLSPEELGRAIYHLAQRRGYKSNRKKALKENEEEKGKVLQGIQTLKADMEAKGARTLGEYFCMLDPEEERIRGRYTERSMYEHEFHLICERQRELVSEELEKKLYKAIFFQRKLKSVKGLIGACQFEPDEKRCTFACEEAQLYRLYTSIDNLRIQKGGELRKLTDTERVAAIAILNGYSDKLDKSGKISLSALGKELHLLKGEKFTLGDEEKNIYGNALHAMLFYVFGEKSANMTPEEQSKFWHDLNSIEKEEVLQRRLASYWELNDEQVRKAMTLALPDDYCSLSLKALRTILPDLEAGIQLRKILELHYPENFRPSNNELAFLPAVDYSGIELRNPVVHRTLTELQKVVNAIIHRYGKPDYIRIELARDLKNTNKEKERITKQNREKEKERVKIIQQIIKEVGIASPTRNDILKVQLAEECGFECPYTGKHFSMAQLFDGNTIQIEHIIPFSRSFDDSYRNKTLCMATENGRKNNRTPYEAYAKEEYKAILTRVSHFKGPFRESKLQIFETKEFSPDDFLQRNLNDTRYASRLAMNYLGLLYGGAIDRNGKRRIQACSGGCTALIRRAWGANYLLGDGEKKREDHRHHAIDALTIAIITPEIVKTVANISKDEYKRRHMQNLPMLDDALYLQAEGKIDSATVSHHVVNKVRGALHNDTIYSKDGNQTYKRIRLDSISLKDIPKIRDKAIRTAVMKALGIDGDKTEAFMDSSLDPAKVFNDEHNLPWLTDKDGKNINRIKSVKVACNDKTRTIGSGDSRREVKPNDNYGLAIFAKIDANGQDKTWIYQVITLMDACQRLKKQLPIINKELQGFKFRFSLMKGDIVTITKDNHNTLCIVRAISEDEIVCTPVTDARQQKELKAAKVWFRLHPATALQLSLQKYQMNLFGDLRRAND

SEQ ID NO: 652 - protein, 1024 aa, Unknown; identical to SEQ ID NO: 650
  Description of Unknown: uncultivated organism
  MG4-253 effector

SEQ ID NO: 653 - protein, 1024 aa, Unknown
  Description of Unknown: uncultivated organism
  MG4-254 effector
MAQTTLGLDLGVASIGWALIREDGTKTTLDGWGSRIFKPGAEDDASDGKGLSLCAIRRQKKALRVQYRRRRKRKDELIRLLQENHLLPDPLTPSFFVNVDRQYLMIFPEEQRKTVGHVIPYLYRRKALDTPLSKEELGRTLYHLAQRRGYLSNRKKDLKDEEESGKVAAGIDTLKKEMEKSGARTLGEYFCLVDPEESRIRTRYTDRAMYQDEFRKICQAQRHLISAELENLLFHVIFFQNKLKSYKHLIGACSVYPEEKRCSYACEEAQIFRIYTTLNHLRIAKADQIRSLTGDEREKVFALLNGFSDLLTRKGSITLRNLGKAIGLGKGEKFTLSDDEKEIYGNVLHAILFSLFGTRAESLSQEEREKFFNDLNSIEKTEVLRRRLKSYWQLPDEKIAAAEKIPVPDDYCAYSLKALKEILPDLAEGIPLATILKLKHPMQAKDEMDQLPILDSDEADIELRNPNVHRVLTELRILINAIIVRYGKPDRIRIELARDLKSSAKERERRMWEMRQREKERTAIAGKIAEEAGIENPSRNDILKVMLAEECGYECPYTGKHFSMRDLLHGKDIHIEHIIPYSRSFDDSYRNKTLCLASANAAKNNRTPFEAFSGKEYQDILQRVARFRGPFAEAKLALFKLEKVEPEEFLERNLNDTRYASRLAMQYLALLYGGIIDKTGKQRIFATSGSCTAMIRRAWGGNYLLGEGEKVRDDHRHHAIDALTIALTTPEMIKVIASMTREERSRKQKSCNDTIIDNEIFRQASADLDNIPVSHHVVNKIRGALHDENPCGKDYGEQIRHKRIELSKLKADSVLKIVDRTVKNIILKRIGCSEKELAGLSEKEFAKRLDAGTPLLFKDKEGGTVNVIKKVRIKAKVTAKTIGSGDSLRNVANGSNYLLAIFAVLDEQGNETAWEGEIVSLMDARYRLTHKMPLFEKDRPGRKFKFTLKKGDIVKFRKDGTEYLCIIRGVSLPQFSCCPVKDARMQRDLKAAKVWFTPTVSAAFQGTMTKYRMNIFGELQRAND

SEQ ID NO: 654 - protein, 1024 aa, Unknown; identical to SEQ ID NO: 650
  Description of Unknown: uncultivated organism
  MG4-255 effector

SEQ ID NO: 655 - protein, 1024 aa, Unknown; identical to SEQ ID NO: 650
  Description of Unknown: uncultivated organism
  MG4-256 effector

SEQ ID NO: 656 - protein, 974 aa, Unknown
  Description of Unknown: uncultivated organism with predicted taxonomy: Planctomycetes
  MG4-257 effector
VESTGLILGLDIGVRSVGWALLDLKAKEIKGLGVRVFDAGVEGNVERGRDTSKAAARREARLRRRQTERQVRKQVKLAHILQDAGLLPEGKVSKPTERHQLLSVLDRQIGESYSSADRGKLPYILRAAALHVALEPFELGRALYHLAQRRGYKSNRKSDAKVDEKQGKVKPAIHELEKKIISVGAETLGEYLAMQDSPKVALRGPGQYTSRDMYLAEFEAIWSEQAKYYPALLTEKLKANVSDAIFFQRPLKSQAHLVGKCQLETGEKRAPWALPIAQRYRMLQTVNSLKVLAADGKARELSASERAKLLEKLECSKKQSFDEIRKCLKLGDDCSFNLEQLGRKEIPGNKTAALLATAFTKKRWASIPEKDKQRIYAVFNSEEDEDKLILIAQDEWKLDEKQARKIAGVSAEAGYCRFSEKALFRLIPYLEAGSDLESAIHKEYPGSRVASEKRDILPPVLSTVQLRSPAVTRALTEVRKVVNAIVHEYGLPETIRIELARDIKRNREERQNINKKISERTKEREAARTRLQEDFNLADPKSSDIEKYLLWQESGPKCPYCGNPIAGEVLFSGATHIDHIIPRKVSLDNSFVNKVLCCSKCNNDKSDRTPHEAFNGDTQRWEKIAERVGAFRSEYRREKLRRVLMTKKEAQEFYTGFTDSQLNDTKFASREAGDYLGLLYGGRVDADGNTRVQMTKGGITSELRNALQLGSIPSQVEDWICDPEEKRGKDRGDHRHHAIDAIAIALSSPGIIKPLMGAYSSSETAKKEMRRDIWASFAKKAAWPGFSDNVVEAVNSISISRRPKHRVRGKLFDENPLSEKGAARKSGDISEAYIRIGKDEAHSRLLKSAGNHHIEIYETKDAKGRPEWKGKAVTLYEAHNRIIDDEPVVNRHHGPNTRFLFSLAVGDTIELGEKQERKLYNVCSVWEDEPGSCRIEYKPLNSATTDRGVNARLNPIRKLKCKKVEVSPLGEHGS

SEQ ID NO: 657 - protein, 831 aa, Unknown
  Description of Unknown: uncultivated organism
  MG4-258 effector
MHSYVLGLDLGSASIGWAILEPNKKVIDCGVRIFDPGVNLEMFNKGQEGSSNNLVRRMARLHRRQLRRRAARQRDLFELLQQHSLLPGNATRDSQQRHDILQHLDSDLRAAWMNRLTAAGVPEQSLIYLVRKQALDAPLEPYEVGRVLYQLAQRRGFKSNRREQAAVEAAEGSKKKSVRAKDEASVVKDGIKELRAEMEAAGARTLGEHFANLSTSGQTIRRHWTDRKWFEAEFEAIWQAQAPHHAALIPELKQQVFQLLFFQRPIATNAHLIGKCELEPTERRAPMANLLAQRFRYLQKLNDLAIDDPLNPQRLTEEQRAVLLSAFECKPDLTFDAIRKLLSFDKAVRFNLERGGEKKLPGNRTNAAMLRAIPDLWPTLSDADKGAIVEQWIDANDDEDLIARLTTHCALSLDDATAICKVHPEDRYHNVSLLAMSRLLPLMEQGVAFKTAENEIYGTRFSGGKPLDLLPPAKDVLASIPNPAVMRALSELRKVVNAIVQKHGKPGQVRIELARDLKRNAKQREMNWRRGRDRETVRTAAVKRILDEAHRPQPWKQDVDRVLLLEECRDLCVYCGQAISFQRLFDGDIDIDHILPRNRFPDDSFANRCLAHRACNQLKLGRTPYEAFGSDEELWPNIIARVKTWDNPDKLERFNLRDDGEFDPEREDSFAARRLNDTRYVSKLAARYVGMLYGGRDVPQPDGAAKRVVFASTGMLTASLRRTWGLEAILREPEPAETSRKPGKQRTDNRHHAIDAIVIALTSNAVIQKASSVAATGSYGDAARAISRVQPPWGDFVGDFVDSIRPAIERMVVSHRPSHKLLGALHEETNY

SEQ ID NO: 658 - protein, 1073 aa, Unknown
  Description of Unknown: uncultivated organism with predicted taxonomy: Acidobacteria
  MG4-259 effector
MPLRADLPPYVLGLDLGSASLGWALIAIDHQHNPTALIRAGVRIFQPGVEGSAFDIERGKDKSRAADRRTARLHRRQLRRRAARQRDLFNLLQAHALLPGASDGASSSERRHTLLNELDKQLTDCLLRTAADDALAANRIADSLPYQLRKAALDRRLEPHELGRVLYHLIQRRGFKSNRREGKKSKDKQEEQGKVKAGISELQQKIAAAGARTLGEYFAGLDPHQQKIRRLWTARSMFEEEFEQIWRTQEAYAPDLLTQDLKSQIGYLLFYQRPIASQEHLIGRCELEPGEPRAPWATLEAQEFRVLQKVNDLAIVIPGSLHDQSLTREQREKVYLALQDTGDQKFSALRKLFELPRVQFNLERGGEKTLRGNRTHAHMFSVFGARWNEFSTDEKKRAVQVWRTAEDPGDLIAKGMEEFGLEEALARRWADVEPEDGYCSLSLKAIGELLPQMREGVSFKTVEREKYGEPFSGQEPQELLPRIREALPTLRNPAVERAVTEMRNVVNAIIREYGKPYEIRLEMARELRKSRKERENVTKRNRSRERERQQAKARILQECGLQNPSRADIEKALLFEECGGVCPYTGRTIEFSSLFRDSQFDVEHIIPLSRYPDDSFLNKTLCYHEENRSVKRGRTPWEAYGPDSERWDAILSRVQGFNNPAKLTRFKLRTEEELGEFTQRQMNDTRYTTRLAADLLGSLYGGRDETLPDGAKRRAIFATTGQVTATLRRVWNLESILREALPSANGESKGKPRTDHRHHAIDAIVVALTSQRTVQLLSMAAAQSVAGESRSRVFTGIQSPWPNFVDSIRPHIEQMIVSHRPEHKMSGELHDETNYGRPYRDGKKTYVHIRKPIASLSTKDIQAIVDPIVRTAVQKKAEALGGDLSKCEVSQNWPVMPTNKERAVPIRSTRIRKVLDVTAIGEGPRQRFVAESSNHHVEVFASLDAQGRESKWESITVSLLEASERNRKKQKVVQRLYPESEDYTFKFSLMGGDSVDLHRNCDHNLGRCNPALYRVRTIAANGQLSLVKITDARLKQDIQKVSEWWSPMCNALRKLDCRKVVVDLLGRVHPAND

SEQ ID NO: 659 - protein, 815 aa, Unknown
  Description of Unknown: uncultivated organism with predicted taxonomy: Planctomycetes bacterium
  MG4-260 effector
KHLLFYQRPIKAQSHLIGGCELEPGERRAPWASLEAQQFRILQKVNDLETILPGNVTGIRLTPEQRKTVLNLLENSPEATFKKIRKALDLAENIGFNLQRGGETRLKGNLTNARMAEAFSDRWPTMSDEEKKQVVEDWRTIEQNESFMRRAIEYWKLDEAGADWLADQSAPQGYCSISRKAIRRLLPLMMEGKRFKEAETEVYGNRLTGGKVYDRIPPVRDVLRTLRNPAVERSLTELRKVVNALVREHGKPAEVRIELARDLKKPRHERAEAITKNRNREKERVAAKTKLLQELGPGFEHPSRADVEKALLHEECGGVCPYTGRHIEFASLFGENPQFDVEHIIPFSRIPDDSFQNKTLCYHEENRLVKRNMTPFEVYKDPAQYEAILNRVRTWKKLNPGKQRRFELRTLEELEGFSARQLNDTRYASKLACELVGSLFGGRDAQTENGSRQIVFASSGMVTATLRKGWGLEAILREAAPSANGQNRGKPRTDHRHHAIDAITIALSRPKMIATLSRNNAQDPYWPQNGRTAPRIQSPWKDFVGSIRPHFEQMLVSHRPEHRLTGALHDETNYGRPRKDGSKDVVHIRKQVAGLSAGDIENIVDPAVRDAVCTKAREFGGDLKKWTPNEDKEDWPLLVTRTGKPIPIKRVRIKKALRVETIAKGERVRHVALSSNHHVAIFALLDERGREKRWESEIVSLLTAMERKRNRQPVIRTRLPEVPEAAFKFSLMWGDILLLHKDCEHSKNICNPSFWRIRSIWEQGTLTLVRINDARLLTEIRAAKDWLLPSPDTLRKLGAVKVVIDSLGRIHQAGG

SEQ ID NO: 660 - protein, 911 aa, Unknown
  Description of Unknown: uncultivated organism
  MG4-261 effector
NRIGHVLPYLLRKTALDRPLDKYDLGRALYHLAQRRGYLSNRKQELKDSEDFGVVKSKINELRQAMTSSGARTLGEYFSMVNPEEERIRCRYTDRAMYQDEFRKICNAQRQHISEALETELFQVIFFQRKLKSCKHLIGKCQVYPEQKRCSLCHPEAQLFRICTTVNNLRISCDSQIRSLTDDERLRVTEVLNGFSDLFNKSGKITLAKLKQATGLLSSEKFTFGDDEKEIYGNELHNILYRAFGSEAALMSQEKQSCFINDLRSIEKNEVLKKRLTEYWQLSEEKASEVATIKLPDDYCAYSLKALKQMLPDLQAGVNLADWLKCNNHSTESYIELDQLPLVDECGFELRNPVVHRVLTELRRVVNSIISRYGKPDLIHIELARDLKASNKEREQITKRNQQRERERNAIAERIIKETGLEKISRKDILKVMLADECDFTCPYSGKRFSMTELLNGGLVEVEHIIPFSRSFDDSFANKTLCVRELNAKKNNRTPFEAFGGSPQYSEMLTRVKYFKGHFAEHKLNLFKLAEIESSGFLERNLNDTRYASKLSMRYLAFLYGGIVDKNSIRRIFSVAGGCTALIRRAWGGNYLLGEGEKVRDDHRHHAIDAVTVALTTPELVQKIAKLSQEGRRKLNDSTKNFIDNDFYYQAQGMMDSCAVSHHQTNKMRGALHEETIYSKDYGDGQSIRHKRIALDQLSPKDIENIVDPAVKTIILKALKVSAPGDVTKATLKIFKDEANYPQMLDHNGNAVNTIKKVRIARTVNTRTIGKGDGKREVANGANYILAIFAKLNEKGEETGWEGEVVSLMDAVQRKQRRQEIFSKERPGMKFKFSLQKGDIVKINKNGEEKLCRIRGISLPQFYCCQISDARTQNDLKSAGCWYTPTVSAAFNWKMQKYNMNIFGELQTAND

SEQ ID NO: 661 - protein, 1002 aa, Unknown
  Description of Unknown: uncultivated organism with predicted taxonomy: Planctomycetes
  MG6-7 effector
MSEITLGLDIGSNSIGWALLNLDENPSIINVGVRVFQEGVNRDTKGAEISKNETRRMARGARRNRFRRNYRKDKLLRLMKRNGLLPKEASTNGEIFLLNPYQLRAKGLDEKLSLHEFGRVLYHLNQRRGFLSNRKSGKAKDDGIVIKSAGELQQKMDAQGARTLGEYFSRIDITQERIRDNYTFRGMYQKEFDLLWEKQSSFYPEILTPELRQTIADETIFYQRPLKPTDELIGDCALEPDHKRCPRGDWHARRFRILQDVNNLMVCEPDGRKRILTEQERSIALKELFGRKEVGFDSLRKKLGLIENQTFNFEEGSLDKKESKLKGDFFASEMSSKKILGKKGWEALDIATQIEINDLLLDDNLADEEVVEMLKQQYGFSDEQAEAAIKISLPRGYMTYSRLAIQKLLPHLERELRTDEAVQAAYGHIHSVQDTGQTVDFLPLPEDLRNPIVNKALIEARKVINAVIQTYGKPGKIVVEMARDVKGNAKEREELRIKMNRNEKENERARHELIHNMGITRPTRDDILKYKLWQECGRECPYTGRPISQQALFGEHPEFQIEHIIPYSRCLDDSFMNKTLCYVDENRRKGDQTPYEFYKNSDQYEHMLQRIRKLPYPKRQKFTQKEVSLDEFIKRQLNDTRYITREILRYLKQLGCTVTGSRGKVTSELRHQWGLNSILESDLPGPKNREDHRHHAIDAVVTALTNQKHLHELAATKYAVAHDGFPVPWEGFRDAVAQAVNKIQVSHRVTRKVSGPLHEETSYGPTGLKDDKGQDIFVYRKKLEALTCPMVEKIVDPVVKEVVKTRLLEFGIDPKKKGSIPKEVWAEPLYMKSTKSAKVPIKKVRIRDVFNNMIPVNDEIGKPYRYVASGNNHHIEIFEYTDAKGNLKRNGKVISMFEAVQRSRQGKPVIYRDYGDGKRFVCSLAKNEMFMLEVEEGRHILHRVQKFGEVGGTIIIVLRPHTFAGKVNDSDKPPYIQRKTPNTLKGYKVTIDPLGRIFPAKD

SEQ ID NO: 662 - protein, 994 aa, Unknown
  Description of Unknown: uncultivated organism with predicted taxonomy: Planctomycetes bacterium
  MG6-8 effector
MSDYTLGLDMGSNSIGWALLDTNNRAVVDAGVRVFQEGVDRDTKGAEVSKNETRRTARSARRARKRRNYRKDKLFRMLIRHGLLPKGPDELKEVFELDPYLLRAKGLDEKLDAYEFGRVLYHLNQRRGFWSNRKSGKSKEDGVVVKSATALAEAMDESRSRTIGEYFAGVDSHEKRIRGHYTFRSMYEEEFEALWTKQASFDGELFTDGLKKAIKDETIFFQRPLRWDPETIGDCELEPGEKRCPRADWHARRFRILQTVNNLKLYNPDGREGDLSKYRETIIGELCNRKEVYFDSLRRKLGLIDSQTFNFEEGAAEKKAKLKGDEFVPQLKKAIGAKALKGLEEADIIEINDALIDDNIEDEELVEKLMEQYGFSEEQANGVVNISLPSKYTNFSRLALQKLLPKMEAGLRTDEAIEAVYGKRQAVGEIEKRRRLGSVPDLRNPIVMKALWEVRKVVNGLVREYGIPRKIKIEMARDVKGSVKERDEIRVKQWKNEQENKRAEEELKLMGIRNPSFNDRLKYKLWEECGKECPYTGKPISQHQLFGEHPDIQIEHILPYSRTLDDSYMNKTLCYVNENRLKGNETPYEYYAENRVEQWEEILQRIKVLPYAKRRRFWQKEVVLDNFIQRQLNDTRYISREVVKYLKQLGCIVTGTKGQITSELRHQWGLNNILDYTGAGLKNRDDHRHHAVDAVVTAVTEQKHLGGLAASKYDKSGIEFDPPWEGFREQVAEKINAINVSHRVTRKVSGQLHEETSYGPTGLKDDKGQDIFVYRKPLEALTLPMAAKIVDPVVREIVYERLREFGIDPDGKSKIGKEVWKEPLYMKSKSGKGPQIKKVRIRDVFNNMIYIKDDAGKEYRAVAPGNNHHIEIFEYANKKGRIKRDGKVVTMYEAVRRSVNNKQVIRRDYMDDKKFVCSLSKNEMFMLEVEDGVHVLHRVQKLIQDGRIVLRPHTYAGKVSDSDNPPLVQRKNYNTLRGYKVTVDPIGRIHRAND

SEQ ID NO: 663 - protein, 896 aa, Unknown
  Description of Unknown: uncultivated organism
  MG6-9 effector
LNEKLELFEFGRAIYHINQRRGFKSNRKTGKAKEDGKVAKAAGELQKKIEANGCRTLGEYFASINPEEERIREQYTFRTMYEEEFDKLWNRQAEFYKNVLNGDLHKKIRDEIIFYQRPLKPTDDLIGDCELEAGEKRCPRGDWYARRFRLLQDVNNLKVYNPDGTARELEDDESGIILKKLATHKEVKFSSLRKELGLLKTQEFNAEYQIDNKGKKQEKLKGDAFNASMRSKNIFGAKTWDAMDEAEKIKLNEWLVDLDDDELIEKLSSEYGLRDEQIDRVLKISLPQRYMNFSRKAIQKLLSLMEKGKRTDEALAEIYPDRNKRAKGEEKDRLDLPDDLRNPLVNRGLFEVRKLVNAVIREHGKPSGIVIEMARDVKGSLKEREEIQWKMRENEKRNEAARTRLIQDMDILNPSRDDVIKYKLWEECGKRCPYTGKVISLTDLFGSNPVFQVEHILPYSRSLDDSYMNKTLCCVNENRIKGNKTPYEFYSGDEEKYEQVKQQIKVLPWPKRRRFLQKEIKLDECIQREMNDTRYICKEVVKYLKQLGVNVRGSKGRVTAELRHQWGLNSILDLNNSNMKNRDDHRHHAIDAVVTAVTKNEHLRRLAKSKYSKTDSSFSEPWEDFREELAEKVKHINVSHRVRRKVSGKLHEDTSYGLTGAKDDKGQEIFVYRKKIEDLTIPMVSKIADHVVRQIIESRLKKHGIDLDKNQTIPKDVWTKPLYMKNTKSNKKVLIKKVRIRDAFNNMIFLKDKEGKTYRAVAPGSNHHIEIFEYTDKKGKMMRGGEIVTMFEAVKRKREDQPVIKRECGADKKFICSLAMNEMFMLDTNNKEKELHRVQKITQSGNSISIILRPHSYAGKVSDYDKPPIIQRRSPNTLKGHKVTVDMLGRVHLAND

SEQ ID NO: 664 - protein, 996 aa, Unknown
  Description of Unknown: uncultivated organism with predicted taxonomy: Planctomycetes bacterium
  MG6-10 effector
MSKYTLGLDIGSNSIGWALLDTGKSPKIIDLGVRVFPEGVDRDTKGAELSKNATRREARGARRNRWRRAYRKDKLVRMLQREGLLPREFDLIQKLMETNPYLLRAKGLDEQLGLHDFGRVLFHINQRRGFKSNRKTGKASDNNKVAKEAGQLQEAIDNTGCRTLGEYYANLNPEKNRIRSQYTFRSMYEKEFALLWAKQSEFYPEILTEQLKEEIKDKTVFYQRPLKPTDDLIGECDLEEGEKRCPRGDWYARKFRLLQDVNNLKIHHSDGSEDPLTDEQRAIVLEQLKKSKAVKFSSLRKKLGLLETDEFNMEYEVNEKGKKKDKIQGDEFNASMQKNIFGLKRWGEMAEGEKIRLNEWLVDLEDDELIEKLASEYGFSDEQTEKVLKISLPSRYMSFSQKAIKKLLPLMEEGKRTDEALDKIYPDRNQKKQVEAERLGLPEDLRNPLVNKALFEVRKVVNAVIREYGKPAKIAIEMARDLKGSLRERKEIHFKQKENERENKRVRERLKNDFNHVSLNRDNIIKYKLWEECNGLCPYTGKKIPQYALFGENPEFQIEHILPYSRSLDDSYMNKTLCEVHENISVKGNQTPYEAYHHDEEKYEQIKQRIKVLPWPKRRKFLQKEIELDEAITRELNDTRYICREAVRYLKQICSNVKGTRGKITSELRHQWGLNSILNLTDPNMKNRDDHRHHAIDAAVVAVTRNKHLRELAESKYAKTGSGVKFEAPWKDFREELAEKIKHINVSHRVTRKVSGQLHEETAYGPTGLKDDKGQDIFVYRKKLEDFTMPMVGRIVDPVVKEIVVDRLKKHGLNPEKKQTIPKEVWREPLYMKSKTGNGPRIKKVRIRDVFNNMIMLKDQNGKPYRAVAPGNNHHIEIFEYKDKDGNIKRDSKVVSMFEAVRRRRKGEPVIQRDHGEGKKFICSLSTNEMVMMPDKEGNNDLFRVQKMSINKQIYFRHHTAATIDNEETLIRKQANLFNGKKVAVDPIGRVFPAND

SEQ ID NO: 665 - protein, 994 aa, Unknown; identical to SEQ ID NO: 662
  Description of Unknown: uncultivated organism with predicted taxonomy: Planctomycetes bacterium
  MG6-11 effector

SEQ ID NO: 666 - protein, 896 aa, Unknown; identical to SEQ ID NO: 663
  Description of Unknown: uncultivated organism
  MG6-12 effector

SEQ ID NO: 667 - protein, 996 aa, Unknown; identical to SEQ ID NO: 664
  Description of Unknown: uncultivated organism with predicted taxonomy: Planctomycetes bacterium
  MG6-13 effector

SEQ ID NO: 668 - protein, 1063 aa, Unknown
  Description of Unknown: uncultivated organism
  MG6-20 effector
EAFDEANPYTLRKMALYGPLTSEQFGRVLFQQGKRRGLKSNRKAERKADDGDVNRATKRLEAKIADDDCQTLGERLYRIGAGQIADSQNVKPGDLNPHRIRGRYTLRKMYEEEFEKLWNKQEQHIPELRAEGLKSRIRRIIFDQRALRSSKHLIGRCECTGQRRAAKADWYAQEFRLLKDLNHLRIHNSDGSEQDLKKEQRLRLAELLRCTDRLTFDEMRQELGLIDSQIFNLEEGPSATVGQTNEGKKSKVRAGAKRKSLAGNSIESALWKAFGKNWALQTEVRKDEIRQAIVEIEDEEKLMRLAVGLWGLKRTQAEALAKLHLPEGYAKYSLDALKNLVAELRKGLKSERGIAEYEARERCGYNSPVTQSLLDFLPSPVKPDRRPLVNNPIVRQSLFEVRKVVNAIIRQYGRPKRVVVEMIREIKGSLRQRAEIRDQQEASRKDREEIRTMLRDPIEFGKDNPSNDDILAYRLWEQQGHLSPYSGKTICQTDLRRFLNGEGVLEIDHILPYSKSWDNSQSNKCLCFSDENKNKKDFTPRQWLGDGTDAYTSMLQYVAGMKTTGMPFSKRRKFSQLEVDPEDCAKRQLNDTAYIAREVRQYLKCLYSEEELVRDESVVCTRGQVTSDLCWCWELNSILNPDDQRETKNRADLRHHAIDAIVVALTTRQRLFALSQVFAKKHSLAKAKHEPWPHFREDVENAVLAIKVSHRPRKRVSGPLHNDTIYGATDEDGRFVSRKFLTDLTPTMVSRIRDARVREAVVERLRKHGIKAKGADSIRDVGPEETPGDSDKRIPKKIWEEPLILVRKDCTEGPRPTPIMKVRLIGPEKTIRPIRNGAALVKPASTHHLSLFEIRKSNGDPEWIAHFVHLIDAAQIVGERQRRFSMIRKQLGAARLPSSEIKRRLELEQCRLDIELPLIVKTHPDIPSARFLFSLSKGEMLLLSIKGKEQLYRFETAASTTEQMWFLKHNEAAIPKNKRLSKKPDNLRGLKPRKVILDPLGRDVSGTGKVYDRVDSKVGDLAKEIIANGMSNSRGHKLLKQMGLGQLGAQLTAELRRLRSGGL

SEQ ID NO: 669 - protein, 1121 aa, Unknown
  Description of Unknown: uncultivated organism with predicted taxonomy: Arcicella aurantiaca
  MG7-2 effector
MKKIVGLDIGVSSIGWSYVLESEIETDEETEDIIELGSRIIPLSNDDADQFSKGQSITKNKERTQKRTARKTNNRYKLRKHKLGEVLKNQEIIINPELFDLTAYELYALRVRAIHEPITLAELARLWYQFNQKRGYQSLRGVVDEEADKKSDYLSSINDRSQFLKDNKQTVGQFLFNRLKDYEQNRGVIEPITHIIFNRQDYFNEFNLIWERQKMEYPEVLTDELLANIRDRIIFYQRPLMSQKHLVSDCTFEKNHKAAPKSSPLFQVFKIWQDLNHFEIKTKRGAIVAFTVEMKQKVFEVLDNQFDINKTKFWEILELKASEHRLNFKEIRGNVSKAKLVEAFAELDINRPDLLSFDPHGDPDEQPLFRIWHLLYSINEKNADEILLRTLQNTPYNFSEKEAIGLIQKVSFKNDFGSLSSRAMRKILPHLEQGLNYADACLEVGNRHSHYRTKEENNERVLADKLLPLPKNSLRQPVVEKIVNQVINVMNAILADSNLGRPDEIRIELARELKQNIKQRERTERNNNKRQKARKDVVKEILKTFPDMKEKDVTNRMIQKYELFQETNGICVYTGTEMKLGAVLSGQGFDIEHIIPKSRRFDDSFMNKTLADSSTNRDKNDLTAYDFMRKKGMTSFEKFTEIIHKLHKDKKISDTKLDNLLTTLNPVWIAEQEAKALSTDFINRQLNETQYITKQVKAELDKICRTITVTSGGITDYLRHQWGVDDVLKNINLEKYEAAGKVSDEDYRDRQGHWRTRKKIADWSKRDDHRHHAIDALVIACTKPAYIKRLNDLNQEYDSYKEMKKDGGKMESLTKFPQPKMKGGFIQNVTKATENILISFKAGKKAVSTSKNKKTGQVNIIPRGQLHEETVYGQKFDESGKPYFVIRKKLEFNKQGYFNSLAQIDKIEDEIIKKKVLKRIDEYGGDLQKALSTVIYHNEDQKIPIKKVMIQAQIKKAVPLGNHEGKFVAEGNNHHLALYRNEKGKYLTELVSVWTAVVRKQNDLDIICRNHPEGLKFITCFQQNEMFIYELSPEQVQEAIDRKDRKLLSKYLYRMQKISKKESGGIEVGFRHHLETKIDDSETAKKIKKFFIVQGVETLLKFTKVKINHLGQITKIFAEGE

SEQ ID NO: 670 - protein, 781 aa, Unknown
  Description of Unknown: uncultivated organism with predicted taxonomy: Flavobacteriales
  MG7-5 effector
MKKIVGLDIGVSSIGWSYVLESEIETDEETEDVIAMGSRIIPLSQKDTDEFSKGDSITKHKARTQKRTARKTNNRYKLRKHQLGEVLNNQGIIINPELFGLTARELYALRVRAVHEPITLSELARLWYQFNQKRGYQSLRGVVDEEADKKSDYLSSINERSQFLKDNKQTVGQFLFNRLQDYEQNRGVIEPITHIIFNRQDYFNEFNQIWERQKLEYPEILTDELLANIRDRIIFYQRPLMSQKHLVSDCTFEKNHKAAPKSSPLFQVFKIWKDLNHFEIKTKRGAIVEFTVEMKQKVFGVLDNQFDINKTKLWEILGLKASEHRLNFKEIRGNVTKAKLVEAFTELNINRPDLLSFDPHGNPDEQPLFRIWHLLYSINEKNADEILLKTLQNAPYSFTEKEAIGLIQKVSFKNDFGSLSSRAMRKILPHLEQGLPYDKACLEVGIRHSHYRTKEENNERILADKLLPLPKNSLRQPVVEKIVNQVINVMNAILADPNLGRPDEIRIELARELKQNIKQRERTESNNNKRQKARKDVVKEILKTFPDMKEKEVTQRMIQKYELFQETNGICVYTGTEMKLGAVLAGQGYDIEHIIPKSRRFDDSFMNKTLADSSTNRDKNDLTAYDFMRNKGMTAFEKFTEIIHTLHKNKKISDAKLDNLLTTLNPVWIAEKEAKELSTDFISRQLKETQYITKQVKAELDKICRKITVTSGGITDYLRHQWGVDDVLKNINLEKYEAAGKVHDEEYRDRQGHWRTRKKIADWSKREDHRHHAIDALGIAC

SEQ ID NO: 671 - protein, 774 aa, Unknown
  Description of Unknown: uncultivated organism with predicted taxonomy: Arcicella aurantiaca
  MG7-6 effector
MKKIVGLDIGVSSIGCSYVLESKIETDEEIEDVIAMGSRIIPLSKEDTDEFSKGQTITKHKARTQKRTARKTNNRYKLRKHQLGEVLNNQGIIINPELFGLTARELYALRVRAIHEPVTLSELARLWYQFNQKRGYQSLRGVVDEEADKKSDYLSSINERSQFLKDNKQTVGQFLFNRLQDYEQNRGVIEPITHIIFNRQDYFNEFNQIWERQKTEYPDILTDELLANIRDRIIFYQRPLMSQKHLVSDCTFEKNHKAAPKSSPLFQVFKIWQDLNHFEIKTKRGAIVDFTVEMKQKVFEILDNQFDINKTKFWEILGLKASEHRLNFKEIRGNVTKAKLVEAFSELNINRPDLLLFDPHGDPDEQPLFRIWHLLYSINEKNADEILLKTLQNAPYSFTEKEAIGLIQKVSFKNDFGSLSSRAMRKILSHLEKSLNYADACLEVGNRHSHYRTKEENDERILADKLLPLPKNSLRQPVVEKIVNQVINVMNAILADPNLGRPNEIRIELARELKQNIKQRERTESNNNKRQKARKDVVKEILKTFPDMKEKEVTQRMIQKYELFQETNGICIYTGTEMKLGAVLSGQGYDIEHIIPKSRRFDDSFMNKTLADSSTNRDKNDLTAYDFMRNKGTTAFEKFTEIIHKLHKDKKISDTKLDNLLTTLNPVWIAEQEAKALSTDFISRQLNETQYITKQVKAELDKICKKITVTSGGITDYLRHQWGVDDVLKNINLEKYEAAEKVHDEEYRDRQGHWRTRKKIADWSKRDDHRHHAI

SEQ ID NO: 672 - protein, 1131 aa, Unknown
  Description of Unknown: uncultivated organism
  MG7-9 effector
MKKVLGLDLGIASIGWALIAQNSENEEISHIIDCGVRVVPLSTDEHSEFAKGGSVPTNQIRRRARGMRRNLQRYRWRRHRLYCVLGQLGMMPDQRLMTRLSPLELYSLRSRALSEPLSLQEIGRILIHLNNWRGYRSNRREAVKDDEKSRYLKEIKNNEDQLKVEDKTIGQFFAERLHQGDRQRIRGRIFGRNTYIDEFNRIWDAQAQYHPSVLTEEHRRLIRDRIIYYQRPLKSAKGLVGTCALEWYYALYKETRQPKYENGRKKIVRPKCAPKSSPLNQECKVWESIHNLRIYRRDRNGRRESQPIALTLEQKKHLFWYLQESKKNLKAEEALRLLGFSAGAYAVDDHTLENNRTLSRLKEVFKKLGIRRDDLLRFDPAIEEVEWDDLETGERRRRLQVRGDFDREPLYQLWHLIYATEDEGDLIQLLEERYGFTTEQAREIAKIDFTSEGYARKSHRALRRLLPHYREGLDYTKACEAAGYRHADYITKAENEARILSERLELLPKNALRNPVVEKILNQMVHLVNDLMTTYGRPDEVRVELARELKQSAQERKKTHELNQKRRRENERIKKDIADHLAIPPEKVTRAQIEKYRFYKEIDGISLYTGKRFSLADVLNGDTVDVEHIIPRTLRFDDSYHNKTLCERNINQEKGNMTACDYMRSRGAQEYEAYLERVKAFYEKNGREVRLKYKNLTTTQEDLLKDNEFLQRQLRESQYIARKAVEVLREVCRNVYTTTGSITDFLRHRWGWDEVIPYLRLPQFKEAGLTEIIPVQNGQKTKEVIKGWSKRDDHRHHALDALVVACTRQSHIQRINELSPILAGTYGEERRQQLLDIVRDKYIAGKIPFSFRQVCEAMNQVLVSHKQRTRVATRNCPKGSQKVQITLTPRGRLHEETIYGRIRRYKKVSLDGKFSVAMLDDMVHPHQRELVEARLAQYANNPKAAFKDLDKNPIRYGPNGEKHLREVTVWEYIMVSRKALDPKATGKALKGIIDPVVHQVVKQHFEAGNVGGLPFRHVRVENRAEEWIRLPRGYAEPGSNHHIAIYRDADGKKHEHVVTFWEAFQRVHIGLPPIITDVAGALEYLSHLPGELPELHLPENPDWQFVVSLARNDMFVFGLDPADIDLRDLKN

SEQ ID NO: 673 - protein, 1225 aa, Unknown
  Description of Unknown: uncultivated organism with predicted taxonomy: Bacteroidetes
  MG7-10 effector
MEKVLGLDLGVSSIGWAMTLQDPNNEERSEIIDCGVRIVPLDTDEIKEFGKGGNVPTNVARRQARGMRRNLQRYRWRRQQLFRALKQLGMLPDERLLRQLSPLQLYALRERALSEPLSLPEMGRVLIHLNQWRGYRSNRKEQTESDGKKPSEYLEQIEKNEERLQGQTIGQYFAARLRESGGYRIRQQLFSRETYKQEFDRIWEKQAEYHPQVLTEANRSWIRDRIIYWQRPLKSAKGLVGECALEWCYALDKNQQPIRLPNGQLKIVRPKCAPKSSPLVQVCNVWESIHNLRVYDHFGEERPLSQEEKERLFRILQDRSLTARQIIKDVLLLSPKTHTVDRLIQEKGLEYNRTRARLLEVFKEQKINREDLLEFNPVIEEVEWDNPETGERLRRLQVRGDFTQQPLYQLWHLLYATEDERNLVALLQKRYGFTEAQAKALAKLDFTSAGYARKSHRALRRLLPHYQRGLDYAAAAQAAGYRHANQMTKEENQARPLLDRLEVLPKNSLRNPVVEKVLNQLVHLVNDLIATYGRPDEIRIELARELKQSAQERQQIEKLINKNKKTNEEARKKIAEILGIDPQAVSRTMIEKWKLYEETDGLSLYSGKKIDLPTLLRGNAVDIDHIIPRVSRFDDSFQNKIFCEASLNQAKSNSTAHDFMRDQPVSGLQPYDDYRKMVKDLYEGKKISKAKYDNLMMTAEDLLKDGEFLQRQLRETQYIAKKAVEMLRQVCREVRSTTGSITDFLRHQWGWDEVIKELRLPQFRQAGEDLIEYRPAANGGRDRVVIKDWDKRKDHRHHALDALVVAFTRVSHIQRVTKLNQIMSGKFGEERRKELLRTGRDLYIAGKAPFTFAQVSKAIANILISFKQGLRVATRSRNRPKGSTTVQITLTPRGALHEETVYGRIKRYKKVPLNGKFSPAMVTEIAHPHQRALVEARLAQHNGDPKKAFKDLEKHPITYGPNGSKHLTHVTVWDYVLVARKSVDASLSEKAVEKIADRGVRRAVAERLKAGGGKSKEAFKNVGTDPVQPPRHHPVKRVRVENYAEKAIRLPRGYVEPGSNHHIAIYRDADGNKHEHVVTFWDAFQRVRLGLPAIITDVPAALQYAQDQLPEGVTDLLLPEGWDWQFVVSLAQNDMFVFDLDPSEINFTDPNNRARISKHLFKVRKLSANDYSFLHHLETEIVDDLVSKSINRCKRCSMSALSRSRAVKVKINRLGHVVEVGQPFS

SEQ ID NO: 674 - protein, 1218 aa, Unknown
  Description of Unknown: uncultivated organism with predicted taxonomy: Bacteroidetes
  MG7-11 effector
MKKVLGLDIGVNSIGWAYIAEPENKNEKYNILGAGSRIIPLNSDETSEFKSGNAISKNSARRIKRGIRRGGHRYKMRKWKLTAKLKELGMFPDKELFSLHSLELYSLRTKAISEKISLQEIGRIFYHLNQKRGYKSNRKANNDENIEVNVSDKPGKKKGYLDLINDRENILTSQKITIGQYFYYKLKEQPFFRIKDNIFTRKSYQQEFKKIWDQQSIYYPNILTEEAFNILFNEIIYFQRPLKSQKHLVTDCRFEFVFAKNNKGELLKDDTGSLRKIKLKAAPKSSPLFQLAKVWQDINNLKIQDTYGNIIEITLEKKKLIADKLQETDKITLKELKKILGLSSKEEYYYNLKKEYIEGNRTFVQLKKILGDNPLLEFNVEINERSISDYNTGETEVRKVINSSIEQSPLYQLWHLLFAAEENENLISTLCKKYSLSPETALALSKLDMTKAGYGALSTKAYRKILPYLMEGSGYSDACQLAGYRHSDYLSKEENESRQLLAKLDLYPINSLRNPVVEKVINQVINLVNAILEDPAYGRPDEIRVELGRELKQNAEERNKTFSRNKKEDAKHKDIIHRLMTECNFKKVSRRDIERYKLWEEFGYVSPYEPSKPISLSELFSGAYEVEHIIPKSRLFDDSFANKTICPRPINAAKDNQTAFDYMSGLGQQKLDEFTDFIQKHKTKKDGISQTKAKYLLCKGSEIPQDFINRQMRETAYISREVKNLLLGICRNVHSTSGTVTNYLRHIWGLDSILQELNIEKYRACGQTVKEIIGSNGSTKENERIVNWSKRDDHRHHAIDAIVIALTKQSHIQKLNNLNQEFQNYRELKQSAYNFPLPWATVHSDVLRTVSNILVSFKSGKKVATKNINRIKKNGKVVKELPTLTPRGFLHKDKFYGKIKRYETVPLTPRFKEWDRIADNNIYNQLKERLSRYKDNTKLAFSENEKDPIPKSLQSITLFQEKFVIRQELNKDFNLARTENIIDERIKRIVKGRLSQNQGNPIKAFGDLENDPIWINKEKAIDIKAVRCFTDLKDLSSLHKNDKGENIHYVSTKNNHHIAIYEDQNGNLAFNAASFWDALNRKLHDLPVIIKDPKSLWNKVLEKGIDNQDVLSNLPPENCSFRTSLQQNEMFIFGMTREEIEDDIRNENYSRISKGLYRVQNISTGKGIDVFFRHHLETKLQDSNNDKEVGKFIRCRTLNSLSLIKVLINYTGSIYLYD

SEQ ID NO: 675 - protein, 1223 aa, Unknown
  Description of Unknown: uncultivated organism with predicted taxonomy: Bacteroidetes
  MG7-12 effector
MEKVLGLDLGVSSIGWAMTLQDPNNEERNEIIDCGVRIVPLDTDEIKEFGKGGNVPTNVARRQARGMRRNLQRYRWRRQQLFRALKQLGMLPDERLLRQLSPLQLYALRERALSEPLSLPEMGRVLIHLNQWRGYRSNRKEQTESDGKKPSEYLEQIEKNEERLQGQTIGQYFAARLRESGGYRIRQQLFSRETYKQEFDRIWEKQAEYHPQVLTEANRSWIRDRIIYWQRPLKSAKGLVGECALEWCYALDKNQQPIRLPNGQLKIVRPKCAPKSSPLVQVCNVWESIHNLRVYDHFGEERPLSQEEKERLFRILQDRSLTARQIIKDVLLLSPKTHTVDRLIQEKGLEYNRTRARLLEVFKEQKINREDLLEFNPVIEEVEWDNPETGERLRRLQVRGDFTQQPLYQLWHLLYATEDERNLVALLQKRYGFTEAQAKALAKLDFTSAGYARKSHRALRRLLPHYQRGLDYAAAAQAAGYRHANQMTKEENQARPLLDRLEVLPKNSLRNPVVEKVLNQLVHLVNDLIATYGRPDEIRIELARELKQSAQERQQIEKLINKNKKTNEEARKKIAEILGIDPQAVSRTMIEKWKLYEETDGLSLYSGKKIDLPTLLRGNAVDIDHIIPRVSRFDDSFQNKIFCEASLNQAKSNSTAHDFMRDQPVSGLQPYDDYRKMVKDLYEGKKISKAKYDNLMMTAEDLLKDEEFLQRQLRETQYIAKKAVEMLRQVCREVRSTTGSITDFLRHQWGWDEVIKELRLPQFRQAGEDLIEYRPAANGGRDRVVIKDWDKRKDHRHHALDALVVAFTRVSHIQRVTKLNQIMSGKFGEERRKELLRTGRDLYIAGKAPFTFAQVSKAIANILISFKQGLRVATRSRNRPKGSTTVQITLTPRGALHEETVYGRIKRYKKVPLNGKFSPAMVTEIAHPHQRALVEARLAQHNGDPKKAFKDLEKHPITYGPNGSKHLTHVTVWDYVLVARKSVDASLSEKAVEKIADRGVRRAVAERLKAGGGKSKEAFKNVGTDPVQPPRHHPVKRVRVENYAEKAIRLPRGYVEPGSNHHIAIYRDADGNKHEHVVTFWDAFQRVRLGLPAIITDVPAALQYAQDQLPEGVTDLLLPEGWDWQFVVSLARNDMFVFDLDPSEIDFTDPNNRARISRHLFKLRKASKKQYWFLHHLETEVLEDLASKKAYRCKQCSMESLAGAVKVKINRLGHVVEVGQPFS

SEQ ID NO: 676 - protein, 1134 aa, Unknown
  Description of Unknown: uncultivated organism with predicted taxonomy: Deltaproteobacteria bacterium
  MG7-13 effector
MKKILGLDIGTNSIGWALITEPENGESGEPEILRCGVKVIAMDQKQINAFEGGQALSANQERRLKRQMRRNNWRYKLRREALVARLVELGWFPREWKDDLQARHEALKLHDARYIYGLRDKAARGERITLRELGLIWYHLNQKRGYKSNRKAQDEEESNDSVLLSQIAANDQLLREQGLTVGQYLYQQHKEHPRRPLKGKVFSRKAYLEEFDRIWEAQAAHYPDILTPELREEIRDRIIYYQRPLKSQKHLIAECPFEKRYYKDANGQLQVKGIKVAPRSSPVFQEYKIWQTLANIRITNLALAGQMGFDDRGERPLTEQERELAYQYLIKKKKVKSDTLLKRALRLDPEAGGYSIDNYEEIEGDVTRAAILSAFKKAEQRPPQWLFRFDPTREIEQQPLFQLWHMLYSIEDPAALQRKLQEKFDFDDELAAALTRVTFKEDYGSLSTRAMQRLIPHLKNGLTYDKARVKVYEETGIDSYKTHTLSKDEQLQRALAPAIEQIKVNSLRNPVVERIVQHVINLVNAIIADKSLVSDEERQSGKFEIRMEMARELKQTAKQRQKTSKQIRAREQQREAARNRLIEEGILTRPSRADIDRYLIWLEGNQMCPYTFKPIPISDLFNGRCDVDHIIPRSRLFDDSQLNKVVCYAAANREKGNRTAYEYMEQKGELEKFREHVMNTNYPFPKKKRLLSPEVPEDFIQRQLKETQYITKVVREKLWEVSHEVRTTTGAITGFLRHEWGLSNLLHDLNFPKYEAQGLVEEWVDEETGEVIKRIEDWSKRMDHRHHALDALVVALTRPAHVHYLNNLNKQFGNLARENGWRTPLRSPVTNLYQKARAAMEPILVKHQKKSRVVTSMTHRLKVKGHFSGKTQEVLVPRGPLHKESVYGLIHDNGKEEFVIRYPLDTNFRPEYVPYIVDKKVQQIVAARLRQFGNDPKKAFADLESDPIWFDEERKIPVKRVRCRTGLQAVVPVHHKADGTSVDYVQTRNNHHLAIYQRPDGSRFHRIVTFWEAVERINQGQPLYQPTIEDGQLLLTLSANDMFVFELDPDEIDFTNPANYGLISRHLYRVQKMTGDDRKLDIWFRHHLDPTTEHRKPYGEMGNFRRITSLSKLVGTKVWLDQTGRIVQHLRCIG

SEQ ID NO: 677 - protein, 1134 aa, Unknown
  Description of Unknown: uncultivated organism with predicted taxonomy: Deltaproteobacteria bacterium
  MG7-14 effector
MKKILGLDIGTNSIGWALITEPENGESGEPEILRCGVKVIAMDQKQINAFEGGQALSANQERRLKRQMRRNNWRYKLRREALVARLVELGWFPREWKDDLQARHEALKLHDARYIYGLRDKAARGERITLRELGLIWYHLNQKRGYKSNRKAQDEEESNDSVLLSQIAANDQLLREQGLTVGQYLYQQYKEHPRRPLKGKVFSRKAYLEEFDRIWEAQAAHYPDILTPELREEIRDRIIYYQRPLKSQKHLIAECPFEKRYYKDANGQLQVKGIKVAPRSSPVFQEYKIWQTLANIRITNLALAGQMGFDDRGERPLTEQERELAYQFLIKKKKVKSDTLLKRALRLDPEAGGYSIDNYEEIEGDVTRAAILSAFKKAEQRPPQWLFRFDPTREIEQQPLFQLWHMLYSIEDPAALQRKLREKFDFDDELAAALTRVTFKEDYGSLSTRAMQRLIPHLKNGLTYDKARVKVYEETGIDSYKTHTLSKDEQLQRALAPAIEQIKVNSLRNPVVERIVQHVINLVNAIIADKSLVSDEERQSGKFEIRMEMARELKQTAKQRQKTSKQIRAREQQREAARNRLIEEGILTRPSRADIDRYLIWLEGNQMCPYTFKPIPISDLFNGRCDVDHIIPRSRLFDDSQLNKVVCYAAANKEKGNRTAYEYMEQKGELEKFREHVMNTNYPFPKKKRLLSPEVPEDFIQRQLKETQYITKVVREKLREVSHEVRTTTGAITGFLRHEWGLSNLLHDLNFPKYEAQGLVEEWVDEETGEVIKRIEDWSKRMDHRHHALDALVVALTRPAHVHYLNNLNKQFGNLARENGWRTPLRSPVTNLYQKARAAMEPILVKHQKKSRVVTSMTHRLKVKGHFSGKTQEVLVPRGPLHKESVYGLIHDNGKEEFVIRYPLDTNFRPEYVPYIVDKKVQQIVAARLRQFGNDPKKAFADLESDPIWFDEERKIPVKRVRCRTGLHAVVPVHHKADGTPLDYVQTRNNHHLAIYQRPDGSRFHRIVTFWEAVERINQGQPLYQPTIEDGQLLLTLSANDMFVFELDPDEIDFTNPANYGLISRHLYRVQKMTGDDRKLDIWFRHHLDPTTEHRKPYGEMGNFRRITSLSKLVGTKVWLDQTGRIVQHLRCIG

SEQ ID NO: 678 - protein, 1003 aa, Unknown
  Description of Unknown: uncultivated organism with predicted taxonomy: Collinsella
  MG14-1 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKYVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 679 - protein, 1034 aa, Unknown
  Description of Unknown: uncultivated organism
  MG14-3 effector
MAKLAPIADPRDFGFDPETVASALMPYEQFSSKPRRLILGIDMGVASIGLALIDVLNGEIVLMASHIFKQPIVDKTKVSLAVSRRGYRSSRRNITREKNRKKAIRKLAADTGIAPAGAAADWFARRKGEPEVLALRVDALTRKLTDRELARILYSFASHRGYIDHGKGDKGDTEDGKVKKALSANLKILDEGGYETYAQYLATQPRSRNKRDDYTFSIDIATVAHEVSRIFAHQREMGNTKATVSLEQSYLAALCWLTDTTKKDKKTYDKVGYCTYLGKPEKRAASSALSYELVRAYQTLANVKIEHRGAAPTCISPKTRNEIVADLFKVTGKPKPLKWSQLRKRLHMAETDTFAGRLKSDEAADCIKLPAWTALCAGLYDKAPKLLEDMHEEPDFADSVCSCLTFASGESSLRSALGNLSADFTPAELAALLDLPYTSKAFSGYGTSGLKALHMLRSAFESEDVVTLYDAEEATGLYEARAALAADRNASLDGLLSPYVEFDPTCTNPVVLRATARLRRMVNSVIKHYGMPDAIRVELARELKHSAHEKRLINASKNKNEKVNAKARQDLIDYYHLPSDAHIKTGDFRKVKLYNEQGGKDPYTGEGIDFARMLAQSDYTEIDHILPISRSCDDSQSNKVLVLTKSNRDKSNRTPYEWMTSGESTAPDFAEFSARMQLWAENCELKRLASSKLKKLLNKDFTDKTQDFIARQLNDTRYMSRAVAKWLDGCLPFPDDGHRHVFAVSGGATAMLRRAWDIAILDEEGKKDRDDDRHHAIDAALIAACTPSIVMKVAKANEMWQSDAERESLFLGSMPFPDFKQKVEAWIPCIVPTLYLPRNATGSLFNDSFYSYRGTDARGKDLLKQNGTVKPKTTVWKDGNGTAKTYDGVYGLHAVFDKDRGKSGRWLFDPIYYVDIPHLSKDRMRVFSKDKAIDYWETTEIDPESPQLMIKMGDVLLQDGRAMRFYNFNVATGGICSYVTGAPHKSLQKTGPLSCESFPTPMKWASDLKIMHEDSLGLCWLRFLVARTESCDGA

SEQ ID NO: 680 - protein, 1005 aa, Unknown
  Description of Unknown: uncultivated organism with predicted taxonomy: Coriobacteriales
  MG14-4 effector
MQSTVNREIGKLGLPRHLVMGMDPGISSCGFALIDTKNHEILEMGVRLFDSPTHPKTGQSLAVIRRGFRSTRRNIDRTQARLKHCLETLKRYGVVPQDATKDYFHTAKGDKQPLKLRVEGLDRLLTNREWALVLYSLCKRRGYIPHGEGSQDKSSEGGKVLSALAANKEAFDQGSFRTVGEWLASQPQSRNRGGSYDKCVTHAQLVNEAHTLFEKQRAFESKVASTELEAAYIEVCDWERSRKDFDCRTYELVGYCSYFPQEKRAARCTLTSELVSAYGALGNVTIIHEDGSSRSLTAAERDECIAILFSCEPIRGNKDCTVKFGALRKVLDLSSGDYFKGVPTSEEKTREVYKPKAWRVLRNTLNPINPILLHRLRDDRDLADSVMEAVAYSSALPVLEEKLQELPLSEAEVTALCKLPYSSKVLNGYGNRSKKALDILLGCFEEPEVLTLTDAEDASGLLAMRIEGAGLERSDRLMPYEGWIEKTGRTNNNPVVIRAMSQMRKVVNAICRKWGVPNEIHVELDRELRLPQCAKDDIAKANKKNEKNRERIAGQIAELRGCSVEEVTGKQIEKYRLWEEQECFDLYTGDSIDVMRLIQDDSYTQIDHILPFSRTGENSKNNKVLVLAKSNQDKREQTPYEWMHSGKPSAPSWSDFERRVQENQKLSRRKKNFLLEKDLDSKEGEFLARSFTDTAYMSREVCSYLSDCLLFPEDGSKVHVVPTTGRATAWLRRRWGLNFGSTGEKDRTDDRHHATDACVIAACSRSLVIKTAKISQETHWSVTPGLTESQRKDARMKALESVMPWETFANEVRSRHDFVVPTRFVPRKGKGELFEQTTYQYAGVNDKGKDLARRVGSDKDIVMGNAVVSEDGKSVVKVSEMLCLRLWHDPDAKKGKGCWYADPVYKADIPALKDGSYVPRIAKAHSGRKAWKPVPESALKGGTIEIYLGDIVRIGDFIGRFSGYDINSANWSFVDRLTRNPIKCPTVGKLNNLIIPIVTRENIVE

SEQ ID NO: 681 - protein, 1005 aa, Unknown; identical to SEQ ID NO: 680
  Description of Unknown: uncultivated organism with predicted taxonomy: Actinobacteria
  MG14-5 effector

SEQ ID NO: 682 - protein, 1037 aa, Unknown
  Description of Unknown: uncultivated organism with predicted taxonomy: Collinsella
  MG14-6 effector
MAKLAPIADPRDFGFDPETVASALMPYEQFSSKPRRLILGIDMGVASIGLALIDVENGEIVLMASHIFKQPIVDKTKVSLAVSRRGYRSSRRNITREKNRKKAIRKLAVKSGIAPAGASADWFARRKGEPEVLALRVDALTRKLTDRELARILYSFASHRGYIDHGKGDKDDIEGGKVKKALSANRKILDEGGYETYAQYLATQPRSRNKKDDYTFSIDIATVAHEVSRIFAHQREMGNTKVTVSLEQSYLAALCWLTDTTKKDKKTYDKVGYCTYLGKPEKRGASSALSYELVRAYQTLANVKIEHRGADATHISPKTRNEIVADLFKVTGKPKPLKWSQLRKRLHMAETDTFAGRLKSDEATDCITLPAWTALCVGLYDKAPKLLEDMHEEPDFADKVCSCLTFASSESSLRGALSQISADFSPVELAALLDLPYTSKVFSGYGTSSLKALHMLRGAFESEDVATLYKAEKATGLYEARAALAANRNASADGLLSPYVEFDPTCTNPVVLRATARLRRMVNSIIKHYGMPDAIRVELARELKHSAHEKRLINASKNKNEKINAKARQDLIDYYHLPSDAHIKTGDFRKVKLYNEQGGKDAYTGEGIDFARMLAQSDYTEIDHILPISRSCDDSQSNKVLVLTKSNRDKSNRTPYEWMTSGESTAPDFAEFSARMQLWAENCELKRLASSKLKKLLNKDFTDKTQDFIARQLNDTRYMSRAVAKWLDGCLPFPDDGHRHVFAVSGGATAMLRRAWDIAILDEEGKKDRDDDRHHAIDAALIAACTPSIVMKVAKANEMWQSDAERESLFLGSMPFPDFKQKVEAWIPCIVPTLYLPRNATGSLFNDSFYSYRGTDARGKDLLKQNGTVKPKTTVWKDGNGTAKTYDGVYGLHAVFDKDSGKSGRWLFDPIYYVDIPHLSKDRMRVFSKDKAIDYWETTEIDSESPQLIIKMGDVLLQDGRAMRFYNFNVATGGICSYVTGAPHKSLQKTGPLSCESFPTPMKWARDLKIMHEDSLGLCWLKFLTDRTDRCALESIQ

SEQ ID NO: 683 - protein, 1003 aa, Unknown
  Description of Unknown: uncultivated organism with predicted taxonomy: Collinsella
  MG14-7 effector
MEITINREIGKLGIPRHLVLGMDPGIASCGFALIDTANHEILDLGVRLFDSPNHPKTGQSLAVIRRGFRSTRRNIDRTQARLKHCLQTLKAYGVIPQDATKEYFHTTKGDKQPLKLRVQGLDRPLSNREWALVLYSLCKRRGYIPHGEGSQDKSSEGGKVLSALTANQEALAETPCRTVGEWLAQQPQSRNRGGNYDKCVTHAQLIDETHILFEAQRSFGSAYASPEFEAAYIEVCDWERSRKDFDRRTYDLVGHCPYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEVVAYSSALPVLQERLQGLPLSEAEIEALCRLPYSSKALNGYGNRSKKALDMLLDCLEEPEVLNLTQAENDCGLLGLRIAGTQLERSDRLMPYETWIERTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDGTYTQIDHILPFSRTGENSRNNKVLVLAKSNQDKREQTPYEWMSHDGAPSWDAFERRVQENQKLSRRKKNFLLEKDLGTKEGEFLARSFTDTAYMSREVCAYLADCLLFPDDGAKAHVVPTTGRTTAWLRRRWGLNFGLTGKKDRSDDRHHATDACVIAACSPSLVIKSAQINQKMHWSMTKGMSKAQRQDAIMKALENVMPWETFANEVRTVHKLIIPTRFVPRKGKGELFEQTVYRYAGVDAKGKTLARRANSTEDIVMGNAVVSDDEKSVIKVSEMLCLRLWHDPKAKKGQGAWYADPVYKADIPALKDGTYVPRIAKAHTGRKAWKPVPESAMKKPPLEIYLGDLVQIGDFVGRFNGYNIDNANWSFVDRLTRIKTSCPTVGKLSNDMSPFVVRESPIK

SEQ ID NO: 684 - protein, 1000 aa, Unknown
  Description of Unknown: uncultivated organism with predicted taxonomy: Olsenella
  MG14-8 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMSSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITEDKGKYPLVRAGENTVKKGNVRINPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 685 - protein, 1002 aa, Unknown
  Description of Unknown: uncultivated organism with predicted taxonomy: Olsenella sp. KH3B4
  MG14-9 effector
MDVTRPYLVLGLDPGIASCGFCLLDMTNHKILEMGSHLFKAPQEDKTKTSLAVTRRNARSIRRNTARTAARLKHCMELLVAAGLVPEDADKTWFQTRKGDKPVLKLRAGGLDRLLTDREFAQVLYSLCGRRGYIPHGEGRLGETDDTEGRKVLDAIKKNQAAMAAGSYRTVGEMLNAQGRSRNRGGDYALCVYNSQIQDEVKALFAAQRAHGNAAATEALEDDYLACLTWEKKSLEHDARVYELVGECPYFPGEKRAASADISSELCRAYERLGHIVIVHEDGSEQTLTANQIDGYLKILFSTASIKGNKDCKVTYGAIRKNLDISGKSVFKGIAQDKEKEEVFAPKAWRCLRHALPEELLARMVEDRQLGDAICEALTFASSEASLIERLSDLDLTDDEREAVLGVPFTGKLFKGYGSRSLKALGLLLGAFEEPEVRTLTDAERATGLLDLRQSDRGVRGQYLPPYNSYDETCRNPVVLRAMGRMRHIVNAIIRIHGVPDEIHIELGRELKMSNKEKSLVDKRNRENAAANKKWAEKAAGILGCTPEEVSGRVIRKLILREEQGEKDLYTGQPIDLERLVRDDRYCEIDHILPYSRTCDDSRTNKVLVLSKSNQDKRERTPYEWMTSGETGAPSWDEYHARIMATVKNPRKRANYLNTDLGPETQAKFLARNLNDDRYMSVAVKNYLEDCLLFPEDGRKRHVIAVAGGATGNLRWVWGLNFGDGNVKDRTDDRHHAVDAAIIAACSESTVKKIAEASSKGREAFKKQRESRLADTQPWPTFADEVKARRAFVVPTRMADHGVTGRVFEDTLYHLEGITADKGKYPLVRAGEKTVKKGNVRINSDGSVKLIDGMAFLRLWLDPTARPNGKVKGKWYAEPVYYADIPAIKAGTYVPRACTIHVARVNWEPVPESAMASEPVVVFFGDVLVVDDKIGRYWSMGITNCAMEIRSLLNGSNLASGFPGTLNGWGKDTQVRVLQEDCLGHCYDGISINPEDSTFQQR

SEQ ID NO: 686 - protein, 880 aa, Unknown
  Description of Unknown: uncultivated organism with predicted taxonomy: Collinsella
  MG14-10 effector
MLTSREWALVLYSLCKRRGYIPHGEGSQDKSSEGGKVLSALAANKEAIAETSCRTVGEWLAQQPQSRNRGGNYDKCVTHAQLVEETHILFEAQRNFGSQYASAELEEAYVQVCDWERSRKDFDRRSYDLVGYCTYFPTEKRAARCTLTSELVAAYGALGNITIVREDGTTRTLTAAERDKCIAILFSCEPIRGNKDCAVKFGALRRELDLNSGDYFKGVPAADEKTREVYKPKGWRTLRNTLNTISPFLLRRLHDDRDLTDSVMEAVAYSSALPVLEEQLQALPLSPTEIGALCKLPYSSKALNGYGNRSKKALDMLLDCLEDSEVLGLTQAEDDCGLLGLRTQGAQLKRSEHLMPYEMWVELTGRTNNNPVVIRSMSQMRKVVNAICRKWGVPNEIHIELDRELRLPQRAKDDIAKAHKKNEKNRERIAGQIAELRGCSPEDVSGKLIEKYRLWEEQEYFDLYTGTKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSFTDTAYMSREVCAYLADCLLFPEDGTKSHVVPTTGRATAWLRRRWGLNFGTNGEKDRSDDRHHATDACVIAACSRSLVIKTAHISEQTHWTVTKNLDKDERNRLRMKALENVMPWETFANEVRASHDFVIPTRFVPRKGKGELFEQTTYRYAGVNDKGKDLARKANSDQDIVMGNAVVSEDGKSIIKVSEMLCLRLWHDPEAKKGQGCWYADPVYKADIPALKDGTYVPKIAKAHTGRKAWKPVPESAMKHAPLEIYLGDLVKIDDFIGRFSGFDINSANWSFSDRLTRQKLNCPTVGRLNNALLPTIIRESTID

SEQ ID NO: 687 - protein, 813 aa, Unknown
  Description of Unknown: uncultivated organism with predicted taxonomy: Collinsella sp. AF20-14LB
  MG14-11 effector
MAAFENPRESGFDPELVKTALMSREQFCSKPRKLILGIDMGIADIGICLMDELNYEIVLMATHLFDCPRNPKDQTSLASTRRQARSQRRNIARRAARKKHIRTILMAHGVIPEGTTADWFSVRRGEQDNIQLRVKGLSEVLTDRELARVLYAFASRRGYIDHGKADNDKDAGKVKKALKANAEIMEANGYETFAQYLVTQPRIRNRQNDYTHCIDIDMVVDEVHAIFRHQRELGNELATESLEGEYLATLRWLTDTTRRDRIIYSKVGYCTYLGEPVKRAPKSSISSEMVRAYQTLANVKIEHIGGPATQIAPAVRNQIVHELFKVSKNPKPLKWSQLRKKLDLADTATFAGIRQSDEKNDACVTAPAWNALCSTLHDLNPTLLNRLHDDIDLADAVCAAATFASSSEAFATRIAELTDGLSKEDVEALLELQYGSKLFTGYGSTSLKALQMLRDAFEDAKIERLYDAEVATGLYDAREALAARHNAPDNGFLKPYSSYSPICTNPVVLRSCAQLRRIINSIIRHYGLPDTIRVEVANDLKHTKREKKLITSGNIYNRKVNEKAKDDIVEFLGLANADRVRGRDLEKVRLYNEQGGKDPYTGQGIDFGRMLTEKSYVEVDHVLPFSRSCDNSKTNKVLVLTKSNRDKANRTPYEWMTSGEPTAPNWDEFCIRMDVWASGKEPKHYYSSKLAKLKEDNFTNNIDSFISRNLNDTRYMSKDVAKWLADCLPFPKDGRRHVFCVSGAATGLMRRVWRIGILDENGKKDREDDRHHAVDAAVIAACTPSVVKSIALISEEHATHRDADRLLNRSLPY

SEQ ID NO: 688 - protein, 1005 aa, Unknown
  Description of Unknown: uncultivated organism with predicted taxonomy: Collinsella
  MG14-12 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRGGNYDKCVTHAQLIEETHILFTAQRSFGSKYASPEFEAAYIEVCDWERSRKDFDRRTYDLVGHCSYFPTEKRAARCTLTSELVAAYGALGNITIIHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKLSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 689 - protein, 1005 aa, Unknown
  Description of Unknown: uncultivated organism with predicted taxonomy: Collinsella
  MG14-13 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEDNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKAIDLSSGDYFKGVPAADEKTREVYKPKGWRVLRNTLNAANPILLQRLRDDRNLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKVSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 690 - protein, 1000 aa, Unknown
  Description of Unknown: uncultivated organism with predicted taxonomy: Olsenella
  MG14-14 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 691 - protein, 1005 aa, Unknown
  Description of Unknown: uncultivated organism with predicted taxonomy: Coriobacteriales
  MG14-15 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEDNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKVSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 692 - protein, 1046 aa, Unknown
  Description of Unknown: uncultivated organism with predicted taxonomy: Eggerthellales
  MG14-16 effector
MDKALGTDIGELGFDPGTFATALMTLEEFRSKDRVIWAGLDIGVASTGLCLVDVLNHEIVLMASHLFKSPVVDKKKATAAPESLASVRRGARSVRRNIMREGRRKKAIRAALSDFGLIPADAGGEWFAARRDERTVVRLRPKALEYLLNSREFARVLYSFASHRGYIDHGKSDKDDDAGKVKKALAANHAALADGGCKTFGQYLAGQPRSRNRPGNYSYTADIDMTVDEVRTIFARQRELGSEIASEALEERYIAELTWLTDTSKRDMSTYLKVSLCTYLGAPYRRGATSTISFEMVRAHQTLCNTVILHADGTSSTIPGNIRIEIVRELFAVKKSVKPLKWSGLRRRLGLAECDSFKGSPAEEEKRDCIALPAWAVLCSGLYEGHRDLLERLHDHIDDADAVCSALTYATSAASLAGRLAPLALTDDEVEAIIDLPYSARLFSGYASASLEALQMLRGTLEDPCVTSLRQAEEDSGLAQARAMLAEERGGAADGLLCAFSDYDPTCKNPVVLRATAQVRRMVNSAIRHYGLPDVIRVEVARELKRSKHEREVVAESNRARRELNEQAKRDIVEFLGLPDDHHVRGRDLDMVKLYREQGGKDPYTGAGIDFRRMLEEHGYAEIDHILPISRTCDDSQANKVLCLTKSNRDKSNRSPYEWMTSGEAAAPDWDEFCGRMDRWAKMCEPRRYVRKKLANLTCENLAEHAEDFIKRNLNDTRYMSAALAKWLRECLPFARDGHEHVFCVAGGATALMRSVWDIGITGPDGKKNRDDDRHHAVDAAVIACCTPGIVKNVALVNEGHARADVRQRLFSDSLPYPEFKEQVNAWIPCIVPTLTLPNTVTGSVLKDTVYPYLGRDEAGKDLYLTVKRDKDGRIVERKVNKATTMWKDGQGGCRAYGSMRALDAVFDASAGKRGRWSFDPVYCIDIPHRDAERRTIRAFSKEKAIDLWDTVEVPEAAPRMTIRRGDVLVCDGKAARFHCFDISVNAIRLFSQRGGKQLQATGPLSAEAFPPPSKWGEGVRVMQEDCLGLCWLSFLAQRAADMQSE

SEQ ID NO: 693 - protein, 1005 aa, Unknown
  Description of Unknown: uncultivated organism with predicted taxonomy: Collinsella
  MG14-17 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRDGNYDKCVTHAQLIEETHILFTAQRSFGSKYASPEFEAAYIEVCDWERSRKDFDRRTYDLVGHCSYFPTEKRAARCTLTSELVAAYGALGNITIIHEDGTSRALSATERDECIAILFSCEPIRGNKDCAVKFGALRKALDLSSGDYFKGVPAADEKTREAYKPKGWRVLRNTLNAANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 694 - protein, 1000 aa, Unknown
  Description of Unknown: uncultivated organism with predicted taxonomy: Olsenella
  MG14-18 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMLEDRKLGDAVCEALTFASSEASLIERLSDLGLSDDERDAILAVPFTGKLFKGYGSRSLKALDLLLGAFEEPEIRILTDAEKVTGLLDLRLSDRGVRGQLLPPYDSYDPTCRNPVVLRAMGRMRHIVNAIIRIHGVPDEIHIELGRDLKMSNKEKKQVEKRNRENAANNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRACAIHIARVNWEPVPEAAMGANPVIVFFGDVLSVDDHVGRFGGFDIFGGRLALLNLLTKQKVSDWPSLGSWGKDTQVRVLQEDCLGHCYDSIAINPEGSTFQQR

SEQ ID NO: 695 - protein, 1005 aa, Unknown
  Description of Unknown: uncultivated organism with predicted taxonomy: Coriobacteriales
  MG14-19 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRGGNYDKCVTHAQLIEETHILFTAQRSFGSKYASPEFEAAYIEVCDWERSRKDFDRRTYDLVGHCSYFPTEKRAAHCTLTSELVAAYGALGNITIVHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKNLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIAHKASSDKDIVMGNAVVSDDEKSIIKVSEMLCLRLWHDPEAKKGQGAWYADPVYKADIPALKDGTYMPRIAKAHTGRKAWKPVPESAMTKPPLEIYLGDLVQIGDFIGRFSGYNIANANWSFVDRLTKEALGCPTVVKLDNKLAPVIIRESIIMRH

SEQ ID NO: 696 - protein, 1005 aa, Unknown; identical to SEQ ID NO: 688
  Description of Unknown: uncultivated organism with predicted taxonomy: Coriobacteriales
  MG14-20 effector

SEQ ID NO: 697 - protein, 1000 aa, Unknown
  Description of Unknown: uncultivated organism with predicted taxonomy: Olsenella sp. KH3B4
  MG14-21 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAVCEALTFASSEASLIERLSDLGLSDDERDAILAVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWHAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 698 - protein, 1005 aa, Unknown; identical to SEQ ID NO: 693
  Description of Unknown: uncultivated organism with predicted taxonomy: Collinsella
  MG14-22 effector

SEQ ID NO: 699 - protein, 1005 aa, Unknown; identical to SEQ ID NO: 688
  Description of Unknown: uncultivated organism with predicted taxonomy: Collinsella
  MG14-23 effector

SEQ ID NO: 700 - protein, 1003 aa, Unknown
  Description of Unknown: uncultivated organism with predicted taxonomy: Collinsella
  MG14-24 effector
MTSTVNREIGKLGLPRHLVLGMDPGIASCGFALIDINNHEILEIGVRLFDSPTHPKTGQSLAVIRRGFRSTRRNIDRTQARLKHCLEVLEKYDVIPQDATKEFFHTTKGDKQPLKLRVEGLDRLLTNREWALVLYSLCKRRGYIPHGEGSQDKSSEGGKVLSALAANKEAFAETSCRTVGEWLAQQPQSRNRGGNYDKCVTHAQLIEETRVLFEAQRNFGSQYASAELEEAYVQVCDWERSRKDFDRRSYDLVGYCTYFPTEKRAARCTLTSELVAAYGALGNITIVHEDGTTRTLTAAERDKCIAILFSCEPIRGNKDCAVKFGALRRELDLNSGDYFKGVPAADEKTREVYKPKGWRALRNTLNTTSPFLLRRLYDDRDLADSVMEAVAYSSALPVLEEQLQALPLSPAEIDALCKLPYSSKALNGYGNRSKKALDMLLDCLEDSEVLGLTQAEDDCGLLGLRIQGSQLERSERLMPYEMWVELTGRTNNNPVVIRSMSQMRKVVNAICRKWGVPNEIHIELDRELRLPQRAKDDIAKAHKKNEKNRERIAGQIAELRGCNPEDVSGRLIEKYRLWEEQECFDLYTGAKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSFTDTAYMSREVCAYLADCLLFPEDGTKSHVVPTTGRATAWLRRRWGLNFGTNGEKDRSDDRHHATDACVIAACSRSLVIKTAKISEQTHWTVTKNLDKDERDHLRMKALENVMPWETFANEVRASHDFVIPTRFVPRKGKGELFEQTTYRYAGVNDKGKDLARKANSDQDIVMGNAVVSDDGKSVIKVSEMLCLRLWHDPEAKKGQGCWYADPVYKADIPALKAGTYVPKIAKAHTGRKAWKPVPESAMKHAPLEIYLGDLVKIGDFIGRFSGYNIDNANWSFTDRLTRQKLSCPTVGKLNNALIPVIIRESSIR

SEQ ID NO: 701 - protein, 1002 aa, Unknown
  Description of Unknown: uncultivated organism with predicted taxonomy: Olsenella
  MG14-25 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKIAEASSKGREAFKKQRESRLADTQPWPTFADEVKARRAFVVPTRMADHGVTGRVFEDTLYHLEGITADKGKYPLVRAGEKTVKKGNVRINSDGSVKLIDGMAFLRLWLDPTARPNGKVKGKWYAEPVYYADIPAIKAGTYVPRACTIHVARVNWEPVPESAMASEPVVVFFGDVLVVDDKIGRYWSMGITNCAMEIRSLLNGSNLASGFPGTLNGWGKDTQVRVLQEDCLGHCYDGISINPEDSTFQQR

SEQ ID NO: 702 - protein, 1005 aa, Unknown
  Description of Unknown: uncultivated organism with predicted taxonomy: Coriobacteriia
  MG14-26 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRGGNYDKCVTHAQLIEETHILFTAQRSFGSKYASPEFEAAYIEVCDWERSRKDFDRRTYDLVGHCSYFPTEKRAARCTLTSELVAAYGALGNITIIHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKLSEMLCLRLWHDPEAKKGQGAWYADPVYKADIPALKDGTYVPRIARAAIGRKAWKLVPKSAMTKPPLEIYLGDLVQIGNLFGRFSGYNIANGSWSFIDRLTKEALSCPSVAKLNNNLFPTIIRESIIMRK

SEQ ID NO: 703 - protein, 1005 aa, Unknown; identical to SEQ ID NO: 693
  Description of Unknown: uncultivated organism with predicted taxonomy: Collinsella
  MG14-27 effector

SEQ ID NO: 704 - protein, 1009 aa, Unknown
  Description of Unknown: uncultivated organism with predicted taxonomy: Collinsella
  MG14-28 effector
MAAFEDPRGHGFDPDLVRTALMSREQFSSKHRKLILGIDMGIADVGVCLMDELNHEIILMAAHLFDCPWNPKTKTSLASARRQARSQRRNIARRAARKKHIREILMAHDVIPEGATAEWFSVRKGDQDNIQLRVKGLSEVLDSRELARVLYGFAGRRGYIDHGKADNDKDAGKVKKALKTNAEIMEANGYETFAQYLITQPKIRNRQDDYTHCVDLDMVVDEVHAIFRHQRELGSNLATESLEGEYLAALRWLTDTTKRDRIIYSKVGYCTYLGEPIKRAPKSSISSEMVRAYQTLANVKIEHIGGPATQIAPAVRNQIVHELFKVSKKPKPLKWSQLRKKLDLDDTATFAGIRQSDEKKDICVKAPGWNTLCSTLHDLNPTLLNRLHDDIDLADAACAAATFASSSESFATRISELTDELSKEDVEALLELPYGSKLFTGYGSTSLKALQMLRDAFEDTSINRLHDAEVATGLYDARKALAAKHNVPDDGLLKPYSSYSPICTNPVVLRSCAQLRRIINSIIRHYGLPDTIRVEVAKELKHTKHEKKLVDDGNKYNKREKEKAADDIVEYLGLSSADQVRGRDIDKVRLYNEQGGKDLYTGQGIDFGRMLTEKGYVEIDHILPYSRSCDNSRTNKVLVLTKSNRDKANRTPYEWMTSGEPTAPNWDEFCIRMDVWASGKEPKHYYSSKLAKLKEDNFTNNIDSFISRNLNDTRYMSKDVAKWLTDCLPFPEDGRKHVFCVSGVATALMRGIWRIGILDDDGKKNREDDRHHAVDAAVIAACTPSIVRGIALISEEHATHRDADRLLNRSLPYPEYRDQVKAWIPCIVPTYSPNRTATGALFEENTYSYRGVNEKGKDLIKKKKGKLGPCTTAWKDGKGSAKAYDKQYSLLAVYDESTLRWLIDPLYYIDVQKRKHEEPFMRKFSKNLSIDYWEKIPLTGTERALFLKPGVVLTQDGLVGRLHSYDISDNKVRMYYARGETSFQKTGPLAGEKFPTFSKWTDNLKVMQE

SEQ ID NO: 705 - protein, 1005 aa, Unknown
  Description of Unknown: uncultivated organism with predicted taxonomy: Coriobacteriales
  MG14-29 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRDGNYDKCVTHAQLIEETHILFTAQRSFGSKYASPEFEAAYIEVCDWERSRKDFDRRTYDLVGHCSYFPTEKRAAHCTLTSELVAAYGALGNITIIHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKVSEMLCLRLWHDPEAKKGQGAWYADPVYKADIPALKDGTYMPRIAKAHTGRKAWKPVPESAMTKPPLEIYLGDLVQIGDFIGRFSGYNIANANWSFVDRLTKEALGCPTVVKLDNKLAPVIIRESIIMRH

SEQ ID NO: 706 - protein, 1005 aa, Unknown; identical to SEQ ID NO: 695
  Description of Unknown: uncultivated organism with predicted taxonomy: Collinsella
  MG14-30 effector

SEQ ID NO: 707 - protein, 1001 aa, Unknown
  Description of Unknown: uncultivated organism with predicted taxonomy: Coriobacteriia bacterium
  MG14-31 effector
MVSPKTTFSERESNYLVLGLDIGIGSCGWCILDKAHNIIVDMGVRLWSPPQENKTKASLASTRRAARSSRRNCKRTKDRKKHCFKLFKAEGIAPSDAEANWVQTKAGEKPTIKLRAAGLNRKLSSREWAQVLYSLCSRRGYIPHGESDDDSEGKAVLAAIKTQQEKLDNNEFRTVGELLANGTHCRNHSGDYSLCVSNNQIRNEVAALFEAQRKLGNKHASETFEQQYLECLTWQKSVTDHDEIIYSKVGPCTYFKQEKRAADSCLSSEMCKAFESICHVTYVDSDGVEGKLPPDIKQRAIDVWFSPTSLPKNKDCKVEYSDLRSWLKAELCIGDDFFFKGVERDDENSKEPFKPSRWRNQRKQLSPSLMLSMRNNRRLADGIDSALAYASSKESLQHQLDELPLSEVDIEELCSLSYSSRLYSGYGTRSLKALDLLIESFESDEVSTLAEAEKASGLLSLRQSSSTEKGFTLPPYIAFDPTCTNPVVLRVMGQVRKVINACIAEYGPFDEVHIELARELKQSAKEKDAILKSNNKTNKSREVLRKKLAEELSCDEDAIPFKLLEKIELWNQQDGRDLYVDEPIQYERLISDDSYCEIDHILPYSRTCDDSRMNKILVLQKSNQNKRESTPFEWMSATGDWDNFKLRILRLAHYPQKKKQRLLNTDLAEKQPEFIARNLNDTRYASLAAKRYIEEYLTFKDNGKSRHVIAVAGGATAALRNAWGIRKDRSEDNLHHAVDASIIAACDESTVIAIAKASERKALTPKDKRKELFSRTEPWQDFANEVLSRKEHIIPSFMTDHKVSGRIFEDTVYRFDGYNEAGTKGILTATKEGMPKSKPSGNYIVRDDGSAVIPDGLAFLRLWWDPTFKVRKGKEPGCYIPEPVFLSDLPKAFDCDYIPLIAPPQKDKKPREKWDSLSEELRNQKPVVLFRNDAIVIGSTVRRFAGFDIDGCSWTLLDPLGKMSQKEATKGLRISSIGPKTRFSVIHEDPLGKCFAPFLED

SEQ ID NO: 708 - protein, 839 aa, Unknown
  Description of Unknown: uncultivated organism with predicted taxonomy: Olsenella sp. KH3B4
  MG14-32 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLIERLSDLGLSDDERDAILAVPFTGKLFKGYGSRSLKALGLLLGAFEEPEIRILTDAEKVTGLLNLRLSDRGVRGQLLPPYDSYDPPCRNPVVLRAMGRMRHIVNAIIRIHGVPDEIHIELGRDLKMSNKEKKQVEKRNRENAANNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKVAEASTKGREAFKQLRKSRLADTQPWPTFATEVAARREFVVPTRMADHGVTGRVFEDTLYHLEGITEDKGKYPLVRAGENTVKKGN

SEQ ID NO: 709 - protein, 1005 aa, Unknown; identical to SEQ ID NO: 693
  Description of Unknown: uncultivated organism with predicted taxonomy: Collinsella
  MG14-33 effector

SEQ ID NO: 710 - protein, 1000 aa, Unknown
  Description of Unknown: uncultivated organism with predicted taxonomy: Olsenella
  MG14-34 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLIERLSDLGLSDDERDAILAVPFTGKLFKGYGSRSLKALGLLLGAFEEPEIRILTDAEKVTGLLNLRLSDRGVRGQLLPPYDSYDPTCRNPVVLRAMGRMRHIVNAIIRIHGVPDEIHIELGRDLKMSNKEKKQVEKRNRENAASNKKWATTAAGILGCTPEEVPGRIIRKLILREEQGEKDLYTGDSIDLEHLVRDDRYCEIGHILPYSRTCDDSRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 711 - protein, 1002 aa, Unknown
  Description of Unknown: uncultivated organism with predicted taxonomy: Olsenella sp. KH3B4
  MG14-35 effector
MERNRPYLVLGLDPGIGSCGFCLLDMTNHRILEMGSHLFDVPQEPKTKTSLAVTRRNARSIRRNTLRTRMRLKHCLGLLKDAGLVPQDADKNWLQSTKGDKPILKLRSCGLDRLLTDRELAQVLYSLCTRRGYIPHGEGRFGETDDVEGRKVLAAIKTNNKAMESGNYRTVGEMLHARGKSRNRGGNYDFCVLNSQIQDEVRTIFSAQRTLGNDRASTEFEEKYLDCLTWEKKTLDHDKRTYDLVGKCSYFPEERRAALACLSSELCRAYERLGHLVIVHEDNSEQVLTAQQIDVYLKVLFSPAPLKGNKDCKVTYSAIRRDLDLSGKSVFKGVSQEKEKDEVFAPKSWRRLRKTLPEDLMVRMRNNRELADDICEALTYASSEDSLLTQLEPLDLSENETEAVLGVPFSGKFFKGYGSRSRKALGILLGAFEEPEVRTLTDAEKATGLLDHRLANDTVRSVLLPPYVTYDETCRNPVVLRAMGRMRHVVNAIIRIHGVPDEIHIELGRDLKMSKREKDAVSKRQRQNEATNKKWAKTAAGILGCEPEEVPGKVIRKLAMREEQGEKDAYTNAPIDLERLVREDHYCEIDHILPYSRTSEDSRANKVLVLSKSNQDKRERTPYEWMTQDVGKPGVPNWDEYHARVVATVKHPRKRANLLNTDLGPETEAKFLARNLNDDRYMSVAVKNYLEDCLLFPDSDRKRHVTAIAGGATGNLRWVWGLNSGSNNTKDRSDDRHHAVDAAVIAACSEATVQKVARARSLGRETFKHMRKSRLADTQPWPTFADEVIARKEFVIPTRMADHGVTGRVFEDTLYHLEGFTDDKGKYPLVRAGQKTVKKGNVCISPDGSAKLIDGIAFVRLWLDPTARPNGKVKGKWYVEPVYYADIPAIRRGAYVPKACTIHVARTSWEPVPETALASRPITLYSGDVLRVDDHIGRYSSTDINGCRLVMLNLDSGNRVNDWPSIGSWGTTTQVQVLQEDCLGRCYGNVILHSDGSTFETR

SEQ ID NO: 712 - protein, 1003 aa, Unknown
  Description of Unknown: uncultivated organism with predicted taxonomy: Coriobacteriales
  MG14-36 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 713 - protein, 1038 aa, Unknown
  Description of Unknown: uncultivated organism with predicted taxonomy: Coprococcus comes
  MG14-37 effector
MVEYSDPRDFGFRPETVMTALMPYEQYSSKTRRLILGIDMGIASVGVCLIDIRNHEIILMASHIFKAPVEGKQKDISARQSGASIRRDYRSVRRTTKRRKNRKKAVREIEKKYILIPDDADGQWFAIRKGEPDVLHLRGKALLYKLNGRELARILYAFAGRRGYIDHGKGATDNDSGKVKKALSENRKILDENGYETIAQYLLKQPTSRNREGDYRYMVDIEMVTDEVHTIFRHQRDLGSDIATEGLEGEYLSALRWLTDTSARDEKIYSRVGYCTYLGAPEKRAASSLISFEMVRAYEKLSNIKIEHQGREATYISPEKRNEIVESLFAVSKNPKPLKWSQLREKLGMQSSDSFDSRLPTDEKSDCIKIPAWNALCTGLFTSNRALLDRLHDDTDIADAVCSALTYASSGESLRNALENLSLDLSEQDIDSLLDLPYASKLFSGYCSTGVRALQMLRDAFKDPQIEKLYDAEMATGLYEARQALAAERNESKDGLLCPYLEFDPTCTNPVVLRATAQVRRMINSIIRHYGLPDIIRVEVAKDLKRSKHEKAIIAATNKANKDSNEQAKKDLVAFYGLPNDAHVSSADFEKMWLYREQFGQDPYTGKGINLERMLNERDYVEIDHILPFSRSCDDSKSNKVLCLTKSNRDKANRTPYEWMTSGEPSAPDFGDFCRRMDAWAGKGKSAHYTKSKLSKLKNSTFGKEEQKFIDRNLNDTRYMSRQLAMWVRECLPFPDDRRQHVFCVAGAATSLMRRIWGIGIVDEKGKKDRSDDRHHAVDAAVIACCSPEIVKGIARVNSGRSNIKERERLRYESMPYPEFKAQVEAWIPCIVPTRTVSRTATGSLLKDTVYPYVGVDDRGKDLYRRNGKIEPASTLWKDGEGGCKLYDGVYGLAGVFDRTLKKSGSWRFDPIYYIDVPNVRQDFIRDFSKALSIDYWPKVQLKGNEPRIFLKQGDVLLQDGCAMRYYMYDVSYGGVKSYSRIGKESISLQKTGPLAEEPFPKQMKWDSSLTVMQEDCLGLCWLRFLSDRADQFENSPV

SEQ ID NO: 714 - protein, 1003 aa, Unknown
  Description of Unknown: uncultivated organism with predicted taxonomy: Coriobacteriia bacterium
  MG14-38 effector
MEITINREIGKLGLPRHLVLGMDPGIASCGFALIDTANHEILDLGVRLFDSPTHPKTGQSLAVIRRSFRSTRRNIDRTQARLKHCLQVFKAYGLIPQDATKEYFHTTKGDRQPLKLRVDGLDRPLSAREWALVLYSLCKRRGYIPHGEGNQDKSSEGRKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCPYFPTEKRAARCTLTSELVSAYGALGNITIIHENGTSRALNATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWVELTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDDTYTQIDHILPFSRTGENSRSNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENVMPWETFANEVRVAHDFVVPTRFVPRKGKGELFEQTVYRYAGVNAQGKDIARKASSDKDIVMGNAVVSADEKSVIKVSEMLCLRLWHDPKAKKGQGAWYADPVYKADIPALKDGTYVPRIAKAHTGRKAWKPVPESAMKKPPLEIYLGDLVQIGDFVGRFSGYNIDNANWSFVDRLTRIKTSCPTVGKLSNDMSPFVVRESPIK

SEQ ID NO: 715 - protein, 1002 aa, Unknown
  Description of Unknown: uncultivated organism with predicted taxonomy: Collinsella
  MG14-39 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDALSKLPVKMPTIGRLNNETIPTVIRELLI

SEQ ID NO: 716 - protein, 1038 aa, Unknown
  Description of Unknown: uncultivated organism
  MG14-40 effector
MVEYSDPRDFGFRPETVMTALMPYEQYSSKTRRLILGIDMGIASVGVCLIDIRNHEIILMASHIFKAPVEGKQKDISARQSGASIRRGYRSVRRTTKRRKNRKKAVRDIEKKYVLIPDDADGQWFAIRKGEPDVLHLRGKALLYKLNGRELARILYAFAGRRGYIDHGKGTTDDDSGKVKKALSENRKILDENGYETIAQYLLKQPTSRNREGDYRYMVDIEMVTDEVHTIFRHQRDLGSDIATEELEGEYLSALRWLTDTSARDKKIYSRVGYCTYLGAPEKRAASSLISFEMVRAYEKLSNIKIEHQGREATYISPEKRNEIVESLFAVSKNPKPLKWSQLREKLGMQSSDSFDSRLPTDEKGDCIKIPAWNALCRGLFTSNRALLDWLHDDTDIADAVCSALTYASSGESLRNALENLSLDLSEQDIDSLLDLPYASKLFSGYCNTGVRALQMLRDAFKDPQIEKLYDAEMATGLYEARQALAAERNESKDGLLCPYLEFDPTCTNPVVLRATAQVRRMINSIIRHYGMPDIIRVEVAKDLKRSKHEKAIIAATNKANKDSNEQVKKDLVAFYGLPNDAHVSSTDFEKMWLYREQFGQDPYTGKGINLERMLNDRDYVEIDHILPFSRSCDDSKSNKVLCLTKSNRDKANRTPYEWMTSGEPSAPDFGDFCGRMDAWAGKGKSAHYTKSKLSKLKNSTFGKEEQKFIDRNLNDTRYMSRQLAMWVRECLPFPDDKRQHVFCVAGAATSLMRRIWGIGVVDEKGKTDRSDDRHHAVDGAVIACCSPEIVKGIARVNSGRSNIKERERLRYESMPYPEFKDQVEAWIPCIVPTRTVSRTATGSLLKDTVYPYVGVDDRGKDLYRRNGKIEPASTLWKDGSGGCKLYDGAYGLMAVFDESMKKSGSWRFDPIYYIDVPNVRQDFIREFTKGLSIDYWPKVQLKGDERRIFLKQGDVLLQDGCAMRYYMYNVSNGVVNSYSKIGEKSVPLQKTGPLSDESFPKQAKWDSSLTVMQEDCLGLCWLKFLSDRVGQFENSPV

SEQ ID NO: 717 - protein, 1003 aa, Unknown
  Description of Unknown: uncultivated organism with predicted taxonomy: Collinsella
  MG14-41 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 718 - protein, 1003 aa, Unknown
  Description of Unknown: uncultivated organism with predicted taxonomy: Collinsella
  MG14-42 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGTKIEVDRLISDDTYTQIDHILPFSRTGENSRNNKVLVLAKSNQDKREQTPYEWMSHDGAPSWNAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPKSAMKKPPLEIYLGDLVQIGDFVGRFSGYNIDNANWSFVDRLTRIKISCPTVGKLSNDMSPFVVRESPIK

SEQ ID NO: 719 - protein, 1003 aa, Unknown
  Description of Unknown: uncultivated organism with predicted taxonomy: Collinsella
  MG14-43 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMRYETWIERTGRTNNNPVVIRAMSQMRKVVNAICRKWGVPNEIHVELDRELRLPQRAKDEIAKANKKNEKNSERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 720 - protein, 761 aa, Unknown
  Description of Unknown: uncultivated organism with predicted taxonomy: Olsenella mediterranea
  MG14-44 effector
DFDRRTYDLVGHCSYFPTGKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 721 - protein, 833 aa, Unknown
  Description of Unknown: uncultivated organism with predicted taxonomy: Collinsella
  MG14-45 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFE

SEQ ID NO: 722 - protein, 1003 aa, Unknown; identical to SEQ ID NO: 712
  Description of Unknown: uncultivated organism with predicted taxonomy: Collinsella
  MG14-46 effector

SEQ ID NO: 723 - protein, 767 aa, Unknown
  Description of Unknown: uncultivated organism with predicted taxonomy: Collinsella sp. AM13-34
  MG14-47 effector
YRGAPYRRGATSTTSFEMVRAHQTLANTVILHEDGTSSTIPGNTRIEIVRELFAVKKSVKPLKWSGLRRRLGLSDGDSFKGRPLEEEKRDCIALPAWAVLCSGLYEDHRDLLERLHDHIEDADAVCSALTYASSAASLAGRLSPLALTDDEVEAIIDLPYSARLFSGYASASLEALQMLRGTLEDPCVTSLRQAEEDSGLAQARAMLAEEHGEAADGLLCAFSDYDPTCKNPVVLRATAQVRRMVNSVIRHYGLPDVIRVEVARDLKRSKHEREIVAESNRARHELNEQAKRDIVEFLGLHDDDHVRGRDLDMVKLYREQGGKDPYTGTGIDFGRMLEERGYVEIDHILPISRTCDNSQANKVLCLTKSNRDKSNRSPYEWMTSGEATAPDWDEFCGRMERWAKMCEPRRYARKKLANLTCENLAERAGGFIDRNLNDTRYMSVALAKWLRECLPFARDGHEHVFRVAGGATALMRSVWDIGITGPDGKKNRDDDRHHAVDAAVISCCTPGIVKNVALVNEGHARADVRQRLFRDSLPYPEFKEQVNAWIPCIVPTLTLPNTVTGSVLKDTVYPYLGRDDAGKDLYLTVKRDKDGRIVDRKVNKATTMWKDGQGGWRAYGSMCALDAVFDASVGKRGKWSFDPVYCIDIPHREDEIRTIRAFSKERAIDLWDSIKVPEDAQRMRIRRGDVLVCDGKAARFYCFDISVNAIRLYSQRGGKQLQTTGPLSSEAFPPPSKWGDDIRVMQEDCLGLCWLSFLSNRAIAQMD

SEQ ID NO: 724 - protein, 1003 aa, Unknown
  Description of Unknown: uncultivated organism with predicted taxonomy: Collinsella
  MG14-48 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHRSITRGMNETQRRDAIMKALESVMPWETFANEVRAAHDFVVPTRFVPRKGKGELFEQTVYRYAGVNAQGKDIARKASSDKDIVMGNAVVSADEKSVIKVSGMLCLRLWHDPEAKKGKGAWYADPVYKADIPALKDGTYVPRIAKAHTGRKAWKPVPGSAMKKPPLEIYPGDLVQIGDFVGRFSGYNIDNANWSFVDRLTRIKISCPTVGKLSNDMSPFVVRESPIK

SEQ ID NO: 725 - protein, 755 aa, Unknown
  Description of Unknown: uncultivated organism with predicted taxonomy: Collinsella sp. AF20-14LB
  MG14-49 effector
RAASSLISFEMVRAYEKLSNIKIEHQGREATYISPEKRNEIVESLFAVSKNPKPLKWSQLREKLGMQSSDSFDSRLPADEKSDCIKIPAWNTLCTGLFTSNRALLDRFHDDTDVADAVCSALTYASSGESLRNALENLSLDLSEQDIDSLLDLPYASKLFSGYCSTGVRALQMLRDAFKDPQIEKLYDAEKATGLYEARQALAAERNESRDGLLCPYLEFDPTCTNPVVLRATAQVRRMINSIIRHYGLPDVIRVEVAKDLKRSKHEKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGKEEQKFIDRNLNDTRYMSRQLAMWVRECLPFPDDKRQHVFCVAGAATSLMRRIWGIGIVDEKGKKDRSDDRHHAVDAAVIACCSPEIVKGIARVNSGRSNIKERERLRYESMPYPEFKAQVEAWIPCIVPTRTVSRTATGSLLKDTVYPYVGADDRGKDLYRRNGKNEPASTLWKDGSGGCKLYDGVYGLMAVFDEGMKKFGSWRFDPIYYIDVPNVRQDFIREFTKDLSIDYWTKVQLKGDEPRIFLKQGDVLVQDGCAMRYYKYNVSNGAISSYSKIGEKSVPLQKTGPLSEEKFPKQAKWDSSLTVMQEDCLGLCWLRFLSDRVGKFENFPV

SEQ ID NO: 726 - protein, 1024 aa, Unknown
  Description of Unknown: uncultivated organism with predicted taxonomy: Libanicoccus massiliensis
  MG14-50 effector
MDSEQPPYTLGHDRDEWQEIKKHLTNRPYLVLGLDPGISSCGFCLIDFNNHLILEMGSHLFKAPQQDKNNVSLAVVRRNARSTRRNNRRTAARLSHCLALLKEAGLVPNDVDKAWLQTRKGDKPVTKLRAVGLDRPLSDREFAQVLYSLCGKRGYIPHGEGRAGETDDAEGKKVLKAIADNTKAMESGGYRTVGEMLYRSDKGRSRNRGGNYDLCVYNSQIQDEVKVVFSAQRELGNNRATQELEKSYFECLTWEKKSADHDAKVYELVGPCTYFPEEKRAANADVSSELCRAYERLGHLVIVHEDGAEQTLTSEQIDKYIGILFSPSPIRGNKDCKVTYNTIRKDLDISAKSMFKGVAKEKEKDEVFAPKAWRKLRIILPTSLLTSMIEDRSFGDDICEAIAYSSTEETLSERLETIDLSEDDRETLLSVPFTSKLFKGYGNRSRKALDLLIGAFEEPEIRTLTEAEVATGLKGKRDEGRFPRSTLLPPYNAYDETCRNPVVLRAMGRMRRIINSIIKIYGVPDEIHVELARELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTILDEDTQEGFINRNLNDTRYMSRAVKSYLEDCLIFPKGKREKHVTAVAGGATGNLRWVWGLNFGAHGEKNRKDDRHHAVDAAVIAACNESAVMKVAKTTSMGREQFRKERKARLSNTQPWPTFADEVAAIRELVIPTRMVSHGVTGRMFEDTLYHIDDYTQDRGKYPLVRAKGKQNKGGNIRFISDDTAQKIDGIAFLRLWLDPDAPATGQTRGKWYAEPVYYADIPSIKHGDYVPRAIEQDVARINWQPIPESAKSSGPITVYPGDVVLVDNRAARFSKIGITKCQLTMLNLLSKERVTDWPSIGSWRQDTEVRVLGEDCLGHCYKHIAITRDSSTYRVE

SEQ ID NO: 727 - protein, 1005 aa, Unknown
  Description of Unknown: uncultivated organism with predicted taxonomy: Collinsella
  MG14-51 effector
MEITINREIGKLGLPRHLALGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQKCFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIANANWSFVDRLTKEALGCPTVVKLDNKLAPAIIRESIIMHQ

SEQ ID NO: 728 - protein, 1003 aa, Unknown
  Description of Unknown: uncultivated organism with predicted taxonomy: Collinsella
  MG14-52 effector
MEITINREIGKLGLPRHLVLGMDPGIASCGFALIDTANHEILDLGVRLFDSPTHPKTGQSLAVIRRSFRSTRRNIDRTQARLKHCLQTLKAYGVIPQDATKEYFHTTKGDKQPLKLRVQGLDRPLSNREWALVLYSLCKRRGYIPHGEGSQDKSSEGGKILSALAANKEALAETPCRTVGEWLAQQPQSRNRGGNYDKCVTHAQLIDETHILFEAQRSFGSAYASPEFEAAYIEVCDWERSRKDFDRRSYDLVGRCSYFPAEKRAARCTLTSELVAAYGALGNITVIHEGGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHIELDRELRLPRRAKDEIAKANKKNEKNRERIARQIAELRGCTADEVTGKQIEKYRLWEEQECFDLYTGAKIEIGRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGLTGEKDRSDDRHHATDACVIAACSPSLVIKTAQINQKMHWSMTKGMSKAQRQDAIMKALENVMPWETFANEVRAVHKLIIPTRLVPRKGKGELFEQTVYRYAGVDAKGKNLARRANSTEDIVMGNAVVSDDEKSIIKISEMLCLRLWHDPKARKGRGAWYADPVYKAEISALKGGTYVPKIAKAHTGRKAWKPVPESAMVKPPLEIYLDDLVQIGDFVGRFSGFDIDNANWSFSDRLTRKKLRSPTVNKLSNDLPPLVIREPPIR

SEQ ID NO: 729 - protein, 1004 aa, Unknown
  Description of Unknown: uncultivated organism with predicted taxonomy: Olsenella sp. KH3B4
  MG14-53 effector
MDANRPYLVLGLDPGIASCGFCLLDMTNHKILEMGSHLFKAPQEDKTKVSLAVTRRNARSIRRNTARTAARLKHCLSLLVEADLVPPDADRAWFQTKKGDKPVLKLRATGLDRLLTDREFAQALYSLCGRRGYIPRGEGRLGEADDNDNEGKRVLDAIKKNQEAMEAGAYRTVGEMLNAQGRSRNRGGDYSLCVYNSQVQDEVKTLFKEQRALGNAKATKKLEQAYIDCLTWEKKSLDHDARVYELVGECVYFPEEKRAASADISSELCRAYERLGHLAIVREDGSDQALSAEQIAHYLGILFSTAPIKGNKDCKVTYGTIRKDLDISGKDVFKGVAQDKEKDEVFAPKAWRCLRRTLPQGLLERMFDDRKLGDAVCEALTFASSEASLVERLSGLELSDDEAEAILEVPFTGKLFKGYGSRSLKTLGLLLGAFEEPEIRILTDAEKATGLLDLRLSDRGVRGGLLPPYDEYDRTCRNPVVLRAMGRMRHIVNAIIRIHGVPDEIHIELGRDLKMSNKEKDLVDKRNRENEAAKKKWAKTAADILGIEPEEVPGRIVRKLIMREEQDNWDLYTGDAIDLERLVRDDRYCEIDHILPYSRTCDDSRANKVLVLSKSNQDKRERTPYEWMTSGEAGAPSWDEYRARVMALVKNPHKRANHLNTDLGEEAQAKFLARNLNDDRYMSVAVKNYLEDCLLFPEDGRKRHVTAVAGGATGNLRWVWGLNFGSGNVKDRDDDRHHAVDAAIIAACSEGTVQKVAKASSKGREAFKHLRESRLADTQPWPTFADEVIARREFVVPTRMVDHGVTGRVFEDTLYHLEGITEDKGKYPLVRAGEKVAKQGNVHVNPDGSVKLIDGMAFLRLWLDPTARPNGKVKGKWYAEPVYYADIPAIKAGTYVPRACTIHVARVNWKPVPEAAAQQKPVVLYPGDVLQVGSHVGRYRSFDISNCGLSVNSLVNKDVIAPGFPKTLGGWGKDTQVRVLQEDCLGNCYDHIAINPDDSTFRQR

SEQ ID NO: 730 - protein, 1000 aa, Unknown
  Description of Unknown: uncultivated organism with predicted taxonomy: Olsenella sp. KH3B4
  MG14-54 effector
MDATRPYLVLGLDPGIASCGFCLLDMTNHKILEMGSHLFKAPQEDKTKTSLAVTRRKARSIRRNTARTSARLKHCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTAGEIDDYLKILFSTAPIKGNKECKVTYGTIRKDLDISGKSVFKGIAQDKEKDKPFAPKAWRSLRRVLPERLLARMLEDRNLGDAVCEALTFASSEASLIERLSDLDLSDDERDAILAVPFTGKLFKGYGSRSLKALRLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKTLVLSKSNQDKRERTPYEWMTSGEAGAPSWDSYRARVMAQVKNPRKRANYLNTDLGPETQAKFLARNLNDDRYMSVAVKNFLEDRLLFPEDGRKRHVTAVAGGATGNLRWVWGLNFGEGNIKDRTDDRHHAVDAAIIAACSESTVKKVAKASAKAREAFKQLRKSRLADTQPWPTFAAEVAARREFVVPTRMADHGVMGRVFKDTLYHLEGITEDKGKYPLVRAGEKTVKKGNVRINPDGSVKLIDGMAFLRLWLDPTARPNGKVKGKWYAEPVYYADIPAIKAGAYVPRACTIHVARVNWKPVPEAAMQIEPIMLYAGDVVEINNQLVRYSGFDINGATLYYQSLLNGATTTAIPSLGTWGKDTQVRVLQEDCLGHCYDGIAINPEDSTFQQR

SEQ ID NO: 731 - protein, 1026 aa, Unknown
  Description of Unknown: uncultivated organism with predicted taxonomy: Collinsella
  MG14-55 effector
MAAFEDPRELGFDTELVKTALMTREQFSSKPRKLVLGIDMGIAGIGICLMDKLNQEIVLMATHLFDCPWNPKNKTSLASARRQARSQRRNTARRAARKKHIREILMARGVIPEGVTAEWFSVRKGEQDNIQLRVKGLSEILSSRELARILYGFASRRGYIDHGKADNDKDAGKVKKALKENAEIMDANGYETFAQYLVTQPRIRNRQNDYSHTIDIDMVVDEVHAIFRHQRELGNELATESLEGEYLAALRWLTDTTKRDRIIYSKVGYCTYLGEPIRRGPKSSISSEMVRAYQTLANVKIEHIGSVATHISPLTRNQIVHDLFKVSKNPKPLKWSQLRKKLDLADTDTFAGVRQSDEAKDVCVKVPAWNVLCSTLHDLNPALLNRLHDDVDLADAVCAAATFASSSESFATRIAERTDGLKQEDMEALLELPYGSKLFTGYGSTSLKALQMLRDAFEDTNINRLYDAEVATGLYDAREALAAKRNASDDGLLMPYSKYSPICTNPVVLRSCAQMRRIINSIIRHYGLPDTIRVEVANDLKRTEHERKLITSGNIYNRRTNEKAKDDIVEYLGLSDADQVRGRDIDKVRLYNEQGGKDPYTGQGIDFGRMLTEKGYVEIDHILPFSRSCDNARTNKVLVLTKSNRNKSNRTPYEWMTSGEPTAPNWDEFCIRMDVWASGKEPKHYYSSKLAKLKEDNFTNNIDSFISRNLNDTRYMSKDVAKWLADCLPFPEDGRKHVFCVSGAATAFMRGIWRIGILDDVGKKNREDDRHYAVDAAVIAACTSSIVKGIALISEEHATNRDADRLLDGSLPYPEYRDQVKAWIPCIVPTYSPTRTATGALFKENTFSYKGIDGKGKDLIKKKKGALGPCTTAWKDGKGTARAYDEQYSLLAVYEESAARWLFDPLYYIDVQKRKTEEPFIRKFSKDLSIDYWEKIPLTGNEPSLLLKRGVVLIQDGIVGRYYGYDIAHNNVKLSPSGKVSFQKTGPLAAEKFPTPTKWTDELRIMQEDCLGLCWLEFLTERANHC

SEQ ID NO: 732 - protein, 1003 aa, Unknown
  Description of Unknown: uncultivated organism with predicted taxonomy: Collinsella
  MG14-56 effector
MEITINREIGKLGLPRHLVLGMDPGIASCGFALIDTANHEILDLGVRLFDSPNHPKTGQSLAVIRRGFRSTRRNIDRTQARLKHCLQTLKAYGVIPQDATKEYFHTTKGDKQPLKLRVQGLDRPLSNREWALVLYSLCKRRGYIPHGEGSQDKSSEGGKILSALAANKEALAETPCRTVGEWLAQQPQSRNRGGNYDKCVTHAQLIDETHILFEAQRSFGSAYASPEFEAAYIEVCDWERSRKDFDRRSYDLVGRCSYFPAEKRAARCTLTSELVAAYGALGNITVIHEGGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPRRAKDEIAKANKKNEKNRERIARQIAELRGCTADEVTGKQIEKYRLWEEQECFDLYTGAKIEVGRLISDDTYTQIDHILPFSRTGENSRNNKVLVLAKSNQDKREQTPYEWMSHDGAPSWDAFERRVQENQKLGRRKKNFLLEKDLDTKEGEFLARSFTDTAYMSREVCAYLADCLLFPNDGAKAHVVPTTGRATAWLRRRWGLNFGLTGEKDRSDDRHHATDACVIAACSPSLVIKTAQINQKMHWSMTKGMSKAQRQDAIMKALENVMPWETFANEVRAVHKLIIPTRFVPRKGKGELFEQTVYRYAGVDAKGKNLARRANSTEDIVMGNAVVSDDEKSIIKISEMLCLRLWHDPKARKGRGAWYADPVYKAEISALKGGTYVPKIAKAHTGRKAWKPVPESAMVKPPLEIYLDDLVQIGDFVGRFSGFDIDNANWSFSDRLTRKKFRSPTVNKLSNDLSPLVIREPPIR

SEQ ID NO: 733 - protein, 1000 aa, Unknown
  Description of Unknown: uncultivated organism with predicted taxonomy: Olsenella
  MG14-57 effector
MDVTRPYLVLGLDPGIASCGFCLLDMTNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHTVIVHEDGSEQALTAGEIDGYLKILFSTAPIKGNKECKVTYGTIRKDLDISGKSVFKGIAQDKEKDEPFAPKAWRSLRRVLPERLLARMLEDRNLGDAVCEALTFASSEASLIERLSDLDLSDDERDAILAVPFTGKLFKGYGSRSLKALGLLLGAFEEPEIRILTDAEKVTGLLDLRLSDRDVRGQLLPPYSSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVIAQVKNPRKRANYLNTDLGPETQAKFLARNLNDDRYMSVAVKNFLEDRLLFPEDGRKRHVTAVAGGATGSLRWVWGLNFGEGNIKDRTDDRHHAVDAAIIAACSESTVKKVAEASAKGREAFKQLRKSRLADTQPWPSFAAEAAARREFVVPTRMADHGVTGRVFEDTLYHLEGITEDKGKYPLVRAGEKTVKKGNVRINPDGSVKLIDGMAFLRLWLDPTARPNGKVKGKWYAEPVYYADIPAIKAGTYVPRACTIHVARVNWEPVPEAAMEIEPVVLYAGDVVEINNQLVRYSGFNIRGATLYYQSLLNGATTTAIPSLGSWGKDTQVRVLQEDCLGHCYDGIAINPEDSTFQQR

SEQ ID NO: 734 - protein, 1003 aa, Unknown
  Description of Unknown: uncultivated organism with predicted taxonomy: Collinsella
  MG14-58 effector
MEITINREIGKLGLPRHLVLGMDPGITSCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 735 - protein, 1003 aa, Unknown
  Description of Unknown: uncultivated organism with predicted taxonomy: Collinsella
  MG14-59 effector
MEITINREIGKLGLPRHLVLGMDPGIASCGFALIDTANHEILDLGVRLFDSPTHPKTGQSLAVIRRSFRSTRRNIDRTQARLKHCLQVFKAYGLIPQDATKEYFHTTKGDRQPLKLRVDGLDRPLSAREWALVLYSLCKRRGYIPHGEGNQDKSSEGRKVLSALAANKEAIAETSCRTVGEWLAQQPQSRNRGGNYAKCVTHAQLIEETHILFDAQRSFGSKYASPEFEAAYIEVCDWERSRKDFDRRTYDLVGHCPYFPTEKRAARCTLTSELVSAYGALGNITIIHENGTSRALNATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWVELTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDDTYTQIDHILPFSRTGENSRSNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENVMPWETFANEVRVAHDFVVPTRFVPRKGKGELFEQTVYRYAGVNAQGKDIARKASSDKDIVMGNAVVSADEKSVIKVSEMLCLRLWHDPKAKKGQGAWYADPVYKADIPALKDGTYVPRIAKAHTGRKAWKPVPESAMKKPPLEIYLGDLVQIGDFVGRFSGYNIDNANWSFVDRLTRIKTSCPTVGKLSNDMSPFVVRESPIK

SEQ ID NO: 736 - protein, 1003 aa, Unknown; identical to SEQ ID NO: 732
  Description of Unknown: uncultivated organism with predicted taxonomy: Collinsella
  MG14-60 effector

SEQ ID NO: 737 - protein, 1004 aa, Unknown
  Description of Unknown: uncultivated organism with predicted taxonomy: Collinsella
  MG14-61 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLGRLLNDREWALVLYSLCKRRGYIPHGEGNQDKSSEGGKVLSALAANKETIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRALRNTLNAANPILLQRLRDDHDLADAVMEAVAYSSALPVLQEQLQGLPLSEAEIEALCRLPYSSKALNGYGNRSKKALDMLLDCLEEPEVLNLTQAENDCGLLGLRIAGSQLERSDRLMPYETWIEHTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWGAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKQNYGRKVWKAIPDSLLIQKPLEIYLGDLIRVGDKLGRYNGYNIAKANWSFVDALTKKEIAFPSVGMLSNELRPIVIRKSILDN

SEQ ID NO: 738 - protein, 1003 aa, Unknown
  Description of Unknown: uncultivated organism with predicted taxonomy: Collinsella
  MG14-62 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKFASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALENVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 739 - protein, 1046 aa, Unknown
  Description of Unknown: uncultivated organism with predicted taxonomy: Collinsella
  MG14-63 effector
MDKAPGTDIGELGFDPGAFATALMTPEEFRSKDRVIWAGIDIGVASTGLCLVDILNHEIVLMASHLFKSPVVDKKKATAAPESLASVRRSARSVRRNIMREGRRKKAIRAVLADFGLIPADAGGEWFSARRDERTVVRLRSKALGYLLNPRELARVLYSFASHRGYIDHGKSDKEDDAGKVKKALAANRAELADGGCETFGQYLAAQPRSRNRAGDYSYTADIGMTVDEVRTIFARQRELGSEIASEALENRYIAELTWLTDTSKRDMSTYLKVGFCTYRGAPYRRGATSTISFEMVRAHQTLCNTVIQHADGTSSSIPGDTRIEIVRELFAVKKSVKPLKWSGLRRRLGLSEGDSFKGRPLEEEKRDCIALPAWAVLCSGLYEGHRDLLERLHDHIDDADAVCSALTFASSAASLAGRLAPLALSDDEVEAIIDLPYSARLFSGYANASLEALQMLRGTFEDPRVTSLRQAEEDSGLAQARAILAEERGEADDGLLCAFSDYDPTCKNPVVLRATAQVRRMVNSVIRHYGLPDVIRVEVARDLKRSKHEREIVAESNRARLELNEQAKRDIIEFLGLPDDHHVRGRDLALVKLYREQGGKDPYTGVGIDFRRMLEEHGYAEIDHILPVSRTCDDSQANKVLCLTKSNRDKSNRSPYEWMTSGEASAPDWNGFCGRMERWAKMCEPRRYARKKLANLTCENLAERAGNFIDRNLNDTRYMSVALAKWLMECLPFAKDGHEHVFCVAGGATALMRSVWNIGITGPDGKKNRDDDRHHAVDAAVIACCTPGIVKNVALVNEGHARADVRQRLFRDSLPYPEFKEQVDAWIPCIVPTLTLPSTVTGSVLKDTVYPYLGRDEAGKDLYLTVNRDKDGRIVERKVNKATTMWKDGHGGCRKYDEMCALDAVFDASVGKRGKWAFDPVYCIDIPHRDAERRTMRAFSKEKAIDLWDTVEVPEDALRMTIRRGDVLVCDGKAARFHGFNISDNTIKLFPQRVGKQLQETGPLSDEAFPSPSKWGDGIRVMQEDCLGLCWLSFLAQRAAVTQTE

SEQ ID NO: 740 - protein, 1003 aa, Unknown
  Description of Unknown: uncultivated organism with predicted taxonomy: Collinsella
  MG14-64 effector
MASTVNREIGKLGLPRHLVLGMDPGIASCGFALIDINNHEILEIGVRLFDSPTHPKTGQSLAVIRRGFRSTRRNIDRTQARLKHCLEVLEKYDVIPQDATKEFFHTTKGDKQPLKLRVEGLDRLLTNREWALVLYSLCKRRGYIPHGEGSQDKSSEGGKVLSALAANKEAFAETSCRTVGEWLAQQPQSRNRGGNYDKCVTHAQLIEETRVLFEAQRSFGSQYASAELEEAYVQVCDWERSRKDFDRRSYDLVGYCTYFPTEKRAARCTLTSELVAAYGALGNITIVHEDGTTRTLTTAERDKCIAILFSCEPIRGNKDCAVKFGALRRELDLNSGDYFKGVPAADEKTREVYKPKGWRALRNTLNTTSPFLLRRLYDDRDLADSVMEAVAYSSALPVLEEQLQALPLSPAEIDALCKLPYSSKALNGYGNRSKKALDMLLDCLEDSEVLGLTQAEDDCGLLGLRIQGSQLERSERLMPYEMWVELTGRTNNNPVVIRSMSQMRKVVNAICRKWGVPNEIHIELDRELRLPQRAKDDIAKAHKRNEKNRERIAGQIAELRGCSPEDVSGRLIEKYRLWEEQECFDLYTGAKIEVDRLISDETYTQIDHILPFSRTGENSPSNKVLVLAKSNQDKREQTPFEWMSKEGAPSWDAFKRRVEENQKLGRRKKNFLLEENLEAKEGEFLARSFTDTAYMSREVCAYLADCLLFPEDGTKSHVVPTTGRATAWLRRRWGLNFGINGEKDRSDDRHHATDACVIAACSRSLVIKTAKISEQTHWAVTKDLDKDERDHLRMKALENVMPWETFANEVRASHDFVIPTRFVPHKGKGELFEQTTYRYAGVNSEGKDLARRANSDQDIVMGNAIVSDDGKSIIKVSEMLCLRLWHDPEAKKGQGCWYADPVYKADIPALKDGTYMPKIAKARTGRKAWKPVPECAMRHAPLEIYLGDLVKIGDFIGRFSGYNIANANWSFTDRLTRQKLSCPTVGKLNNALIPVIIRESSIR

SEQ ID NO: 741 - protein, 1003 aa, Unknown; identical to SEQ ID NO: 732
  Description of Unknown: uncultivated organism with predicted taxonomy: Collinsella
  MG14-65 effector

SEQ ID NO: 742 - protein, 1004 aa, Unknown
  Description of Unknown: uncultivated organism with predicted taxonomy: Collinsella
  MG14-66 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYLHTTKGDKQPLKLRVDGLDRLLNDREWALVLYSLCKRRGYIPHGEGNQDKSSEGGKVLSALAANKEAIAETSCRTVGEWLAWQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPFSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREACAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSLDEKSVIKVSEMLCLRLWHDPEAKKGQGAWYADPVYKADIPALKDGTYVPRIAKAHTGRKAWKPVPESAMKKPPLEIYLGDLVQIGDFMGRFSGYNIANANWSFVDRLTKEALGCPTVVKLDNKLAPAIIRESIIMH

SEQ ID NO: 743 - protein, 1003 aa, Unknown; identical to SEQ ID NO: 734
  Description of Unknown: uncultivated organism with predicted taxonomy: Collinsella
  MG14-67 effector

SEQ ID NO: 744 - protein, 1005 aa, Unknown
  Description of Unknown: uncultivated organism with predicted taxonomy: Collinsella
  MG14-68 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFETAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIANANWSFVDRLTKEALGCPTVVKLDNKLAPAIIRESIIMHQ

SEQ ID NO: 745 - protein, 1000 aa, Unknown
  Description of Unknown: uncultivated organism with predicted taxonomy: Olsenella
  MG14-69 effector
MAEPYLVLGLDPGISSCGFALLDMNNHKILEMGSHLFDAPQDSQTKVSLAVGRRSARSARRNNLRTKNRQKHCMELLQEAGLVPQGVTKQWFQSTKGDRPLLELRFAALERPLTNREFAQVLYALSARRGYIPHGEGRISKLSDMDTSGSSDAEAGKVLKAIGENNKLMAQGHFRTVGEMLYDQGKSRNKGGSYERCVLNSQIVDEVHIIFQSQRTQQNTAATQELEAQYVQNLTWEKRTLDHDAKVHALVGKCSYFPGEFRAARADLSSELCNAYERIKHLRIVNADGDEVALAPEQVETYIAILFSPEPLKGKKEKVTYARIRKDLDLSAHLFFKGIDPEDEKDHEPYVPKAWRAMRKVLSTELMERLRSDRTLADAVGEALTYASSEDSLVYQLDNLDLSDEERSQILGLPFSGKIFKGYGSRSLKALDMLVDAFEEPEVTTLAEAEESSGLLGLRMSDRGARYPLLPSYSNYDKENRNPVVLRAMGRMRRIVNAIIRIYGVPDEIHVELGRDLKRSKHEKDLINKRNRENERKNKQWRAQIAEEQGIDPDEVRPKLLRKIALWEEQDNFDIYTGHKIEFDRMISDDKYCEIDHVLPYSRTCDDSRNNKVLVLAKSNQDKRERTPYEWMTQDARKGAPNWDEYQARVIANHHISPRKRRYLLDNNLGPDQESDFLSRNLNDDRYMSREVKSYLEDTLIFPEDGRVKHVIAVAGGATGSLRHVWGLNFGANNSKDRSDNRHHAIDACVIAACSESTLQAVAKARKLGAETYKRMRKDRLKDTQPWPTFADEVIARREFVIPTHMVSHGVTGRAFEDTNYRFDGITNDTKKLGILYGNGKTTKKGNFVIGNDGNAHLVDGMAFLRLWLDPTARKGKGKWYAEPVYYADIPAIKNGTYIPRAAKAHVARVAWEPVPENALASAPVVLFSDNVIKVGSAIARYSRFDIGNAALVLENLRTGEECKKFPTLGRWNNELVPIIINEDCLGHCYKELAPNILEG

SEQ ID NO: 746 - protein, 1026 aa, Unknown
  Description of Unknown: uncultivated organism with predicted taxonomy: Collinsella tanakaei
  MG14-70 effector
MESLVNREVGGLGKPRYLVMGMDPGIKSCGFALLDLNNQEILEMGSRLFDAPTHPKTKQSMAVIRRGYRSTRRNIDRTQDRLKHCLKTLKRFDVVPEDADKEFFHTVKGDKQPILLRTDGLNRLLTSREWALVLYSLCKRRGYIPHGEGSDSGTSEDGKVLAALKANERVFADAGYRTVGEWLASLPQSRNRGGNYDKCVTHAQLTDEVRTLFEAQRGFGSPVASQELEDAYIEVFDWERSREEFDKRAYGLVGTCSYFPNEKRAARCTLTSEMVAAYGALGNITIVKRDGSTHPLSAVERDQCIDILFAVDPMKGNKTCAVKYGFLRKRLDLESGDYFKGVPLDDEKNREVFKPKGWRSLRSVLHETNRELLVKLHDDRDLADAVMEAVAYSSSVDVLKSQLSSLDLSNGEIESICAMPYSSKVLNGYGNRSKKALDILLGCFEDPDVLSLTDAEDASGLGAVRMQGAAIDKGERLIPYETWIALTGRTNNNPVVIRALSQMRKVVNAVCRKWGVPDEIHVELDRELRLPKKAKDEIAKAKKRNEKDRQRVAAQIAELLGCSADDVKGDYIEKYRLWEEQECFDIYSGEKIEVDRLIREETYTQIDHVLPFSRTGDNSRHNKVLVLARSNQLKREQTPYEWMTSNTEGAPSWDAFKRRVEENKKLSRRKKNFLLEEDLVSKEGEFQSRNMTDTAYMSREVCAYLSDCLQFPDDGLKNHIVPIAGRATAWLRRQWGLNFGATGEKDRSDDRHHATDACVIAACSRSLVIKTAKVMKQTHWQVTRDMTREQRRSARMKALEGTMPWSTFANEVRERWKVTVPTRFVPRKGRGELYGQTVYSYLGVDESGKDLGRKKGSNKKIVMGNAVISKDGKSMVKISEMLCLRLWFDPDAKGRGGKKGRWYSDPVYKADLGVIQSNAYIPRVAKAHRGRKAWSPVPQAALRRSPVVIYLGDVVKVGDVVGRFAGFDIDSANWSFVDCLDGKGIAFPTVGSLTSELRPEVIREKVLGNAEVYRSTQDDGTSSGAD

SEQ ID NO: 747 - protein, 862 aa, Unknown
  Description of Unknown: uncultivated organism with predicted taxonomy: Collinsella
  MG14-71 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGAFGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPAVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVISACSRSLVIKTARINQETHWSITRGMNETQRRDAIMKALESVMPWETFANEVRAAHDFVVPTRFVPRKGKGELFEQTVYRYAGVNAQGKDIARKASSDKSDGAG

SEQ ID NO: 748 - protein, 895 aa, Unknown
  Description of Unknown: uncultivated organism with predicted taxonomy: Atopobium sp. ICM42b
  MG14-72 effector
YINRGEETLINGEVSTEVSSESEEAGKVLSAISENKKALKESGYRSFGEYLYKESYVSTRSYRNKAGDYKHCVSHPMVVDEIKELFEQQKKFGNTHTSEEFKYAYLEQLNWLKDTKAFDKLTYQKVGYCVYFDQYSDEPQKRSANADLISEVVKAYEKLGNIRLKFDDKPEQSLTREVRDAVINEMFSVHQGAKVKSVTYKTLRKLIDDDNLIGFKGVKSDLEKNPVFVPKAWNTFCRVLSGSESGIQLLNRMRSDFKFANAIAESLTYASSLDSLERRISMYQEKEDLVISEDELALIESLPYNTKIFKGYGSRSVQALEMLHDQFSDGEAFTLDEAEKQSGLQGFRLREKGIRQSLLPPYSDYDVQCTNPVVLRVLAQARRMINSAIKQYGMPNIIRIELGNDIAKSAKEKSKIAKGQNENRKENERIKDKIAEILHIDQSEVTGKQITKMKLYEEQGGKDIYTGEGLGDIAFAGGRRFLIDDNYCEIDHVLPYSRSADDLKSNKVLVLAKSNQEKGNRTPYEWMNSNDGSHPNWEQFCLRVLSNVRLSDGKKSKLLEENFAEKEVSFIKRNMVDTQYMARAISAWLSDSLNFSTEFNQKQHVYAVNGRMTAKLRRKWGLNFGEDDTKDRSDNRHHAIDAAVIAVCSASMVKEFAISYSRLREVRDSVIAEPWEGFADQVREAREWVIPTMYRPNKKNGLLFEESRYRYVEKKKKHILTSKDGKEKSSGNIRFFENEKDGRHVKIVGNIAYIRLWLDENARKGKGEWLIEPVYFVDLQSIKNGSYVPRYISASHVTSDEWKSIPEEVLSKIPPVVIHIQDVIQVDSSYFRVDGVDIDAKALNLMPVFSDSNNSDPALAKMSKWNKSTEVTRISEDALGLVWFNYLKNQNSSES

SEQ ID NO: 749 - protein, 1003 aa, Unknown
  Description of Unknown: uncultivated organism with predicted taxonomy: Collinsella
  MG14-73 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNTANPILLQRLRDDRNLADAVMEAVAYSSALPVLQEQLQGLPLSEAEIEALCRLPYSSKALNGYGNRSKKALDLLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDSKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGFDINGANWSFSDRLTKKKLRSPTVNKLGNDPLPLIIRESPVR

SEQ ID NO: 750 - protein, 1026 aa, Unknown
  Description of Unknown: uncultivated organism with predicted taxonomy: Collinsella
  MG14-74 effector
MAAYEDPRDCGFDPELVKTALMSREQFGSKPRKLVLGIDMGIAGIGICLMDKLNQEIVLMATHLFDCPWNPKNKTSLASARRQARSQRRNIARRTARKKHIREILMARGVIPEGVTAEWFSVRKGEQDNIQLRVKGLSQILSSRELARVLYGFASRRGYIDHGKADNDKDAGKVKKALKENAEIMDANGYETFAQYLVTQPRIRNRQNDYSHTIDIDMVVDEVHAIFRHQRELGNELATESLEGEYLAALRWLTDTTKRDRIIYSKVGYCTYLGEPIRRGPKSSISSEMVRAYQTLANVKIEHIGSVATHISLLTRNQIVHDLFKVSKNPKPLKWSQLRKKLDLADTDTFAGVRQSDEAKDVCVKVPAWNVLCSTLHDLNPTLLNRLHDDVDLADAVCAAATFASSSESFATRIAERTDGLKQEDMEALLELPYGSKLFTGYGSTSLKALQMLRDAFEDTNINRLYDAEVATGLYDAREALAAKRNASDDGLLMPYSKYSPICTNPVVLRSCAQMRRIINSIIRHYGLPDTIRVEVANDLKRTEHEKKLITSGNIYNRRTNEKAKDDIVEYLGLSEADQVRGRDIDKVRLYNEQGGKDPYTGQGIDFGRMLTEKGYVEIDHILPFSRSCDNARTNKVLVLTKSNRDKSNRTPYEWMTSGEPTAPNWDEFCIRMDVWASGKEPKHYYSSKLAKLKEDNFTNNIDSFISRNLNDTRYMSKDVAKWLADCLPFPEDGRKHIFCVSGAATAFMRGIWRIGILDDAGKKNREDDRHYAVDAAVIAACTSSIVKDIALISEEHATNRDADRLLDGSLPYPEYRDQVKAWIPCIVPTYSPTRTATGALFKENTFSYKGIDGKGKDLIKKKKGALGPCTTAWKDGKGTARAYDEQYSLLAVYEESASRWLFDPLYYIDVQKRKTEEPFIRKFSKDLSIDYWEKIPLTGNEPSLLLKRGVVLIQDGIVGRYYGYDIAHNNVKLSPSGKVSFQKTGPLAAEKFPTPTKWTDELRIMQEDCLGLCWLEFLTERANHC

SEQ ID NO: 751 - protein, 1046 aa, Unknown
  Description of Unknown: uncultivated organism with predicted taxonomy: Collinsella sp. AM13-34
  MG14-75 effector
MDKAKGADIGELGFDPATFATALMTLEEFRSKDRVIWAGLDIGVASTGLCLVDVRNHEIVLMASHLFKSPVVDKKKATAAPESLASVRRGARSIRRNIMREGRRKKAIRAALADFDLIPADADGEWFSARRDERTVVRLRSKALGYLLNSRELARVLYSFASHRGYIDHGKSDKEDDAGKVKKALAANHAALADGGCKTFGQYLAGQPRSRNRAGDYSYTADIGMTVDEVRTIFARQRELGSEIASKALEERYIAELTWLTDTSKRDRSTYLKVGFCTYLGAPYRRGATSTISFEMVRAHQTLCNTVILHADGTSSTIPGDIRIEIVRDLFAVKKSVKPLKWSGLRRRLGLSEGDSFKGRPVEEEKRDCIALPAWAVLCAGLYENHRDLLERLHDHIDDADAVCSALTFASSAASLTGRLAPLALSDDEVEAIIDLPYSARLFSGYANASLEALQMLRGTFEDPRVTSLRQAEEDSGLAQARAILAEERGGSADGLLCAFSDYDPTCRNHVVLRATAQVRRMVNSVIRHYGLPDVIRVEVARDLKRSKHEREIVAESNRARLELNEQAKRDIIEFLGLPDDHHVRGRDLALVKLYREQGGKDPYTGAGIDFRRMLEEHGYAEIDHILPVSRTCDDSQANKVLCLTKSNRDKSNRSPYEWMTSGEASAPDWGEFCGRMERWAKMCEPRRYARKKLANLTCENLTERAGNFIDRNLNDTRYMSVALAKWLRECLPFAKDGHEHVFCVAGGATALMRSVWNIGITGPDGKKNREDDRHHAVDAAVIACCTPGIVRNVALVNEGHARADVRQRLFSDSLPYPEFKEQVDAWIPCIVPTLTLPNAVTGSVLKDTVYPYLGRDEAGKDLYLTVKRDKDGRIVERKVNKATTMWKDGQGGCRAYGSMCALEAVFDASAGKRGRWSFDPVYCIDIPHRDAERRTMRAFSKEKAIDLWDTVAVPEAAPRMTIRRGDVLVCDGKAARFHCFDISVNAIRLFSQRGGKQLQTTGPLSAEAFPPPSKWGEGVRIMQEDCLGLCWLSFLAQRAADVQME

SEQ ID NO: 752 - protein, 1003 aa, Unknown
  Description of Unknown: uncultivated organism with predicted taxonomy: Collinsella
  MG14-76 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGFDINGANWSFSDRLTKKKLRSPTVNKLGNDPLPLIIRESPVR

SEQ ID NO: 753 - protein, 1003 aa, Unknown
  Description of Unknown: uncultivated organism with predicted taxonomy: Collinsella
  MG14-77 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKTNKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 754 - protein, 1004 aa, Unknown
  Description of Unknown: uncultivated organism with predicted taxonomy: Collinsella
  MG14-78 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWELNFGSNREKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 755 - protein, 1003 aa, Unknown
  Description of Unknown: uncultivated organism with predicted taxonomy: Collinsella
  MG14-79 effector
MEITINREIGKLGLPRHLVLGMDPGITSCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 756 - protein, 1003 aa, Unknown
  Description of Unknown: uncultivated organism with predicted taxonomy: Coriobacteriales
  MG14-80 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKYVTHAQLIEETHILFDAQRSFGSKYASPEFEAAYIEVCDWERSRKDFARRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 757 - protein, 1004 aa, Unknown
  Description of Unknown: uncultivated organism with predicted taxonomy: Collinsella
  MG14-82 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSDLPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNREKDRSDDRHHATDACVIAACSRSLVIKTARINQETHWSITRGMNETQRRNAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 758 - protein, 1003 aa, Unknown
  Description of Unknown: uncultivated organism with predicted taxonomy: Collinsella
  MG14-83 effector
MTSTVNREIGKLGLPRHLVLGMDPGIASCGFALIDINNHEILEIGVRLFDSPTHPKTGQSLAVIRRGFRSTRRNIDRTQARLKHCLEVLKKHGVIPQDATKEFFHTTKGDKQPLKLRVEGLDRMLTSREWALVLYSLCKRRGYIPHGEGSQDKSSEGGKVLSALAANKEAIAETSCRTVGEWLAQQPQSRNRGGNYDKCVTHAQLVEETHILFEAQRNFGSQYASAELEEAYVQVCDWERSRKDFDRRSYDLVGYCTYFPTEKRAARCTLTSELVAAYGALGNITIVREDGTTRTLTAAERDKCIAILFSCEPIRGNKDCAVKFGALRRELDLNSGDYFKGVPAADEKTREVYKPKGWRTLRNTLNTISPFLLRRLHDDRDLTDSVMEAVAYSSALPVLEEQLQALPLSPTEIGALCKLPYSSKALNGYGNRSKKALDMLLDCLEDSEVLGLTQAEDDCGLLGLRTQGAQLKRSEHLMPYEMWVELTGRTNNNPVVIRSMSQMRKVVNAICRKWGVPNEIHIELDRELRLPQRAKDDIAKAHKKNEKNRERIAGQIAELRGCSPEDVSGKLIEKYRLWEEQEYFDLYTGTKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSFTDTAYMSREVCAYLADCLLFPEDGTKSHVVPTTGRATAWLRRRWGLNFGTNGEKDRSDDRHHATDACVIAACSRSLVIKTAHISEQTHWTVTKNLDKDERNRLRMKALENVMPWETFANEVRASHDFVIPTRFVPRKGKGELFEQTTYRYAGVNDKGKDLARKANSDQDIVMGNAVVSEDGKSIIKVSEMLCLRLWHDPEAKKGQGCWYADPVYKADIPALKDGTYVPKIAKAHTGRKAWKPVPESAMKHAPLEIYLGDLVKIDDFIGRFSGFDINSANWSFSDRLTRQKLNCPTVGRLNNALLPTIIRESTID

SEQ ID NO: 759 - protein, 1000 aa, Unknown
  Description of Unknown: uncultivated organism with predicted taxonomy: Olsenella
  MG14-84 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRASGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLIERLSDLGLSDDERDAILAVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWHAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 760 - protein, 1003 aa, Unknown
  Description of Unknown: uncultivated organism with predicted taxonomy: Collinsella
  MG14-85 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIHNANWSFVDRLTRIKISCPTVGKLSNDMSPFVVRESPIK

SEQ ID NO: 761 - protein, 1003 aa, Unknown; identical to SEQ ID NO: 717
  Description of Unknown: uncultivated organism with predicted taxonomy: Collinsella
  MG14-87 effector

SEQ ID NO: 762 - protein, 1003 aa, Unknown; identical to SEQ ID NO: 717
  Description of Unknown: uncultivated organism with predicted taxonomy: Collinsella
  MG14-88 effector

SEQ ID NO: 763 - protein, 1002 aa, Unknown
  Description of Unknown: uncultivated organism with predicted taxonomy: Collinsella
  MG14-89 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHENGTSRALSATERDECIAILFSCEPIRDNEDCAVKFGALRKALDLSSGDYFKGVPAADEKTREVYKPKGWRVLRNTLNAANPILLQRLRDDRDLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPSLKDGTYVPKIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 764 - protein, 1003 aa, Unknown
  Description of Unknown: uncultivated organism with predicted taxonomy: Coriobacteriia
  MG14-90 effector
MEITINREIGKLGLPRHLVLGMDPGIASCGFALIDTANHEILDLGVRLFDSPTHPKTGQSLAVIRRGFRSTRRNIDRTQARLKRCLQVFKAYGLIPQDATKEYFHTTKGDKQPLKLRVDGLDRLLSAREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCPYFPTEKRAARCTLTSELVSAYGALGNITIIHENGTSRALSATEHDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEENRERIARQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENAMPWETFANEVRVAHDFVVPTRFVPRKGKGELFEQTVYRYAGVNAQGKDIARKASSDKDIVMGNAVVSADEKSVIKVSEMLCLRLWHDPKAKKGQGAWYADPVYKADIPALKDGTYVPRIAKAHTGRKAWKPVPESAMKKPPLEIYLGDLVQIGDFVGRFSGFDIDNANWSFSDRLTRKKLRSPTVNKLSNDLSPLVIRESPIR

SEQ ID NO: 765 - protein, 1026 aa, Unknown; identical to SEQ ID NO: 746
  Description of Unknown: uncultivated organism with predicted taxonomy: Collinsella tanakaei
  MG14-91 effector

SEQ ID NO: 766 - protein, 1004 aa, Unknown
  Description of Unknown: uncultivated organism with predicted taxonomy: Collinsella
  MG14-92 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLCRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTGKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 767 - protein, 1003 aa, Unknown
  Description of Unknown: uncultivated organism with predicted taxonomy: Collinsella
  MG14-93 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 768 - protein, 1003 aa, Unknown
  Description of Unknown: uncultivated organism with predicted taxonomy: Collinsella
  MG14-94 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGRGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 769 - protein, 1046 aa, Unknown
  Description of Unknown: uncultivated organism with predicted taxonomy: Collinsella
  MG14-95 effector
MDKAKGADIGELGFDPATFATALMTLEEFRSKDRVIWAGLDIGVASTGLCLVDVRNHEIVLMASHLFKSPVVDKKKATAAPESLASVRRGARSVRRNIMREGRRKKAIRAALADFDLIPADTDGEWFSARRDERTVVRLRSKALGYLLNSRELARVLYSFASHRGYIDHGKSDKEDDAGKVKKALAANHAALADGGCKTFGQYLAGQPRSRNRAGDYSYTADIGMTVDEVRTIFARQRELGSEIASKALEERYIAELTWLTDTSKRDRSTYLKVGFCTYLGAPYRRGATSTISFEMVRAHQTLCNTVILHADGTSSTIPGDIRIEIVRELFDVKRSVKPLKWSGLRRRLGLAECDSFKGRPAEEEKRDCIALPAWAVLCSGLYENHRDLLERLHDHIDDADAVCSALTFASSAASLAGRLAPLAITDDEVEAIIDLPYSARLFSGYANASLEALQMLRGTFEDPHVTSLRQAEEDSGLAQARAMLAEERGGSADGLLCAFSDYDPTCRNPVVLRATAQVRRMVNSVIRHYGLPDVIRVEVARDLKRSKHEREIVAESNRARLELNEQAKRDIIEFLGLPDDHHVRGRDLALVKLYREQGGKDPYTGAGIDFRRMLEEHGYAEIDHILPVSRTCDDSQANKALCLTKSNRDKSNRSPYEWMTSGEASAPDWGEFCGRMERWAKMCETRRYARKKLANLTCENLAERAGNFIDRNLNDTRYMSVALAKWLRECLPFTKDGHEHVFCVAGGATALMRSVWDIGITGPDGKKNRDDDRHHAVDAAVIACCTPGIVKNVALVNEGHARADVRQRLFSDSLPYPEFKEQVDAWISCIVPTLTLPNTVTGSVLKDTVYPYLGRDEAGKDLYITVKRDKDGRIVERKVNKATTMWKDGQGGCRAYGSMCALEAVFDASAGKRGRWSFDPVYCIDIPHRDAERRTMRAFSKEKAIDLWDTVAVPEAAPRMTIRRGDVLVCDGKAARFHCFDISVNAIRLFSQRGGKQLQATGPLSAEAFPPPSKWGEGVRIMQEDCLGLCWLSFLAQRAADVQME

SEQ ID NO: 770 - protein, 1002 aa, Unknown
  Description of Unknown: uncultivated organism with predicted taxonomy: Collinsella
  MG14-96 effector
MEITINREIGKLGLPRYLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEASYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENGCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDNRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 771 - protein, 1002 aa, Unknown
  Description of Unknown: uncultivated organism with predicted taxonomy: Collinsella
  MG14-97 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLNRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDTLSKLPVKMPTIGRLNNETIPTLIRELLI

SEQ ID NO: 772 - protein, 1003 aa, Unknown
  Description of Unknown: uncultivated organism with predicted taxonomy: Collinsella
  MG14-98 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGCKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAANEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDDAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNEAQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKQPLEMYLGDLVQIGDFVGRFSGYNIDNANWSFVDRLTRIKISCPTVGKLSNDMSPFVVRESPIK

SEQ ID NO: 773 - protein, 1002 aa, Unknown; identical to SEQ ID NO: 685
  Description of Unknown: uncultivated organism with predicted taxonomy: Olsenella
  MG14-99 effector

SEQ ID NO: 774 - protein, 1004 aa, Unknown
  Description of Unknown: uncultivated organism with predicted taxonomy: Collinsella
  MG14-100 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLCDDRNLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 775 - protein, 1045 aa, Unknown
  Description of Unknown: uncultivated organism with predicted taxonomy: Eggerthella sp. AM16-19
  MG14-101 effector
MDKAQGVDIGELGFDPGTFATALMTLEEFRSKDRVIWAGIDIGVASTGLCLVDVRNHEIVLMTSHLFKSPVVDKKKATAAPESLASVRRGARSVRRNIMREGRRKKAIRAVLADSDLIPADADGEWFAARRDERTVVKLRSKALGHLLNSRELARVLYSFASHRGYIDHGKSDKDDDAGKVKKALAANHAALAGGGCETFGQYLAVQPRSRNRAGDYSFTSDIGMTVDEVRTIFLRQREMGSEIATEALEERYIAELTWLTDTSKRDMSTYLKVGFCTYRGAPYRRGATSTTSFEMVRAHQTLANTVILHEDGTSSTIPGNTRIEIVRELFAVKKSVKPLKWSGLRRRLGLSDGDSFKGRPLEEEKRDCIALPAWAVLCSGLYEDHRDLLERLHDHIEDADAVCSALTYASSAASLAGRLAPLALTDDEVEAIIDLPYSARLFSGYASASLEALQMLRGTLEDPCVTSLRQAEEDSGLAQARAMLAEEHGEAADGLLCAFSDYDPTCKNPVVLRATAQVRRMVNSVIRHYGLPDVIRVEVARDLKRSKHEREIVAESNRARHELNEQAKRDIVEFLGLHDDDHVRGRDLDMVKLYREQGGKDPYTGTGIDFGRMLEERGYVEIDHILPISRTCDNSQANKVLCLTKSNRDKSNRSPYEWMTSGEATAPDWDEFCGRMERWAKMCEPRRYARKKLANLTCENLAERAGGFIDRNLNDTRYMSVALAKWLRECLPFARDGHEHVFCVAGGATALMRSVWNIGITGPDGKKNRDDDRHHAVDAAVIACCTPGIVKNVALVNEGHARADVRQRLFRDSLPYPEFKEQVNAWIPCIVPTLTLPNTVTGSVLKDTVYPYLGRDDAGKDLYLTVKRDKDGRIVDRKVNKATTMWKDGQGGCRAYGSMCALDAVFDASVGKRGKWSFDPVYCIDIPHREDEIRTIRAFSKERAIDLWDSIKVPEDAQRMRIRRGDVLVCDGKAARFYCFDISVNAIRLYSQRGGKQLQTTGPLSSEAFPPPSKWGDDIRVMPEDCLGLCWLSFLSNRAIAQMD

SEQ ID NO: 776 - protein, 1000 aa, Unknown
  Description of Unknown: uncultivated organism with predicted taxonomy: Olsenella sp. KH3B4
  MG14-102 effector
MDATRPYLVLGLDPGIASCGFCLLDMTNHKILEMGSHLFKAPQEDKTKTSLAVTRRKARSIRRNTARTSARLKHCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTAGEIDDYLKILFSTAPIKGNKECKVTYGTIRKDLDISGKSVFKGIAQDKEKDEPFAPKAWRSLRRVLPERLLASMLEDRNLGDAVCEALTFASSEASLIERLSDLDLSDDERDAILAVPFTGKLFKGYGSRSLKALRLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKTLVLSKSNQDKRERTPYEWMTSGEAGAPSWDSYRARVMAQVKNPRKRANYLNTDLGPETQAKFLARNLNDDRYMSVAVKNFLEDRLLFPEDGRKRHVTAVAGGATGNLRWVWGLNFGEGNIKDRTDDRHHAVDAAIIAACSESTVKKVAKASAKGREAFKQLRKSRLADTQPWPTFAAEVAARREFVVPTRMADHGVMGRVFKDTLYHLEGITEDKGKYPLVRAGEKTVKKGNVRINPDGSVKLIDGMAFLRLWLDPTARPNGKVKGKWYAEPVYYVDIPAIKAGAYVPRACTIHVARVNWKPVPEEAMQIEPIMLYAGDVVEINNRLVRYSGFDINGATLYYQSLLNGATTTAIPSLGTWGKDTQVRVLQEDCLGHCYDGIAINPEDSTFQQR

SEQ ID NO: 777 - protein, 1003 aa, Unknown
  Description of Unknown: uncultivated organism with predicted taxonomy: Collinsella
  MG14-103 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 778 - protein, 1003 aa, Unknown
  Description of Unknown: uncultivated organism with predicted taxonomy: Collinsella
  MG14-104 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQKPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICHKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDTFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHVPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 779 - protein, 1005 aa, Unknown; identical to SEQ ID NO: 695
  Description of Unknown: uncultivated organism with predicted taxonomy: Collinsella
  MG14-105 effector

SEQ ID NO: 780 - protein, 1003 aa, Unknown; identical to SEQ ID NO: 728
  Description of Unknown: uncultivated organism with predicted taxonomy: Collinsella
  MG14-106 effector

SEQ ID NO: 781 - protein, 965 aa, Unknown
  Description of Unknown: uncultivated organism with predicted taxonomy: Collinsella
  MG14-107 effector
MEITINREIGKLGLPRHLVLGMDPGIASCGFALIDTANHEILDLGVRLFDSPIHPKTKQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNID

SEQ ID NO: 782 - protein, 1027 aa, Unknown
  Description of Unknown: uncultivated organism with predicted taxonomy: Atopobium sp. ICM42b
  MG14-108 effector
MSKSDRGLVFGIDLGKASCGLAIIDYEAKEVKLLSSRIIKAPENRSGKSLAAVRREKRSIRRQIDRRAARKKNVLKVLKQFGITPQDCDCKWFETKKNGNDGIDLPVIVLRSQGLDRQLSNREWARILYWFCSQRGYINRGEETLINGEVSTEVSSESEEAGKVLSAISENKKALKESGYRTFGEYLYKESYVSTRSYRNKAGDYKHCVSHPIVVDEIKELFEQQKKFGNTHTSEEFRDAYLEQLNWLKDTKAFDKLTYQKVGYCVYFDQYSDEPQKRAANADLISEVVKAYEKLGNIRLKFDDKPEQSLTREVRDAVINEMFSVHQGAKVKSVTYKTLRKLIDDDNLVGFKGVKSDLEKNPVFVPKAWNTFCRVLSASESGIQLLNRMKNDFKLANAIAESLTYASSLDSLERRISMYQEKESLEISEDELALIESLPYNIKIFKGYGSRSIQALEMLHDQFLGGKAFTLDEAEKQSGLQGFRLREKGIRQSLLLPYSDYDVQCTNPVVLRVLAQARRMINSAIKQYGMPNIIRIELGNDIAKSAKEKSKIAKGQNENRKENERIKDKIAKLLHIDQSEVTGKQITKMKLYEEQGGKDIYTGESLGDIAFAGGRRFLIDDNYCEIDHVLPYSRSADDLKSNKVLVLAKSNQEKGNRTPYEWMNSNDGNHPNWEQFCLRVTSNVRLSDSKKSKLLEENFAEKETSFIKRNMVDTQYMARAISAWLSDSLNFSSEFDQKQHVYAVNGRMTAKLRRKWGLNFGEDDTKDRSDNRHHAIDAAVIAACSASMVKEFAISYSRLREVRDSVIAEPWEGFADQVREAREWIIPTMYRPNKKNGLIYEETKYKYLGKEVGDKKIVHILKGKKQGVGTVDLFRDPTGGQFARILGDRAYIRLWLDEEGKSGRGEWLIEPVYFADLDKIKRGSYVPRYIPRQKVTTQEWESIPSRITENSIPIVLRNDDIVRIDGIYGRLSGLDINSKRLKFDRILSKDVKTIGSWTKDTSVEVIHEDCLGLMWFNLLKDQNSKES

SEQ ID NO: 783 - protein, 1031 aa, Unknown
  Description of Unknown: uncultivated organism with predicted taxonomy: Atopobium sp. ICM42b
  MG14-109 effector
MSKSDRGHVFGVDLGKSGNGLASIDYENKDINFLSSRPFKAPENRAGKSLAKVRREARSIRRQLDRKSTRKKQIIKVLKQFSVIAQECDSRWFETKKNGNGGIDLPIIILRSQGLDRKLTNREWARVLYWFCSQRGYINRGEEALSNEEASVEDSSESDEVGKVLSAISDNRKALKKSGYRTFGEYLFKESYEITRSYRNKNGEYRHCVSHPMVVDEINELFKHQQKLGNTYTSEEFREAYLRQLNWLKDTMAFDKLTYQKVGYCVYFDQYSDEPQKRAANADLISEVVKAYEKLGNIRLKFDDKSEQNLTKEVRDAVINEMFSIHQGSRVKSITYKTLRKLIDNENLIEFKGIKSDLEKSSVFAPKAWNFYCRALSISESGLQLLNRMKSDFKFANVISESLTYATSLESLESRILMYQDKESIEISEEELTLIESLPYNSKIFKGYGSRSIEALEMLYDQFTEGEAFTLDEAEKQSGLQSFRLRDKGIKQRLLPPYSDYDPQCTNPVVLRSLSQARKMINSGIKQFGMPDIIRVELAKELTKSPKQREKIAKEQNKNRKENERIRKEIAKYLEIDSSCVTKKQILKKKLYEEQKGLDVYTGESLEPSLHADDLTYLKDDSYCQIDHILPYSRSADDSIANKVLVLAKSNQDKGNRTPYEWMTSGHEHHLSWEEFAIRVSTNLSISDSKKWRLLEEDFNKKEVQFMNRNLSDTQYMSKAIVAWLSDSLDFPSRYGQKQHVYATNGRMTSKLRKEWGLNFGENGIKDRNDKRHHAVDAAVIAACSASMVKEFATSYSRSHETKNSTIAEPWEGFADQVREAREWVIPTMYRPNKKNGLLFEDRRYRYAGKTNKHILIGKEGKEKTSGNIRFFDNEKDGKHVKIVGDVAYIRLWLDVNAREGKGEWLIEPVYFADLQSIKKGTYIPKYIATYNATNDEWKPVPDDVLSKNKPLIVHRQDVIKVDSSFFRVNSVDIAKKTLKLIPVFYDSKNSNPELMITRKWDKSTKIELVYEDVLGMIWFNYLKNQNSSES

SEQ ID NO: 784 - protein, 1003 aa, Unknown; identical to SEQ ID NO: 717
  Description of Unknown: uncultivated organism with predicted taxonomy: Collinsella
  MG14-110 effector

SEQ ID NO: 785 - protein, 1037 aa, Unknown
  Description of Unknown: uncultivated organism
  MG14-111 effector
MEYSDPRDFGFRPETVMTALMPYEQFSSKTRRLILGIDMGIASVGVCLIDIRNHEIVLMASHIFKAPVEGKQKDISARQSGASIRRGYRSVRRTTKRRKNRKKAVRDIEKKYILIPDDADGQWFAIRKGEPDVLHLRGKALLYKLNGRELARILYAFADRRGYIDHGKGATDDDSGKVKKALSVNRKILDENGYETIAQYLLKQPTSRNREGDYRYMVDIEMVTDEVHTIFRHQRDLGSDIATEELEGEYLSALRWLTDTSARDKKIYSRVGYCTYLGAPEKRAASSLISFEMVRAYEKLSNIKIEHQGREATYISPEKRNEIVASLFAVSKNPKPLKWSQLREKLDMQSSDSFDSRLPTDEKDDCIKIPAWNALCTGLFMSNRALLDRFHDDTDAADAVCSALTYASSGESLRNALENLSLDLSEQDIDSLLDLPYASKLFSGYCSAGVRALQMLRDAFKDPQIEKLYNAEKATGLYEARQALAAARNESRDGLLCPYLEFDPTCTNPVVLRATAQVRRMINSIIRHYGLPDIIRVEVAKDLKRSKHEKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGEEEQKFIDRNLNDTRYMSRQLAMWVRECLPFPDDKRQHVFCVAGAATSLMRRIWGIGIVDEKGKKDRSDDRHHAVDAAVIACCDQRIVKGIARVNSGRSNIKERERLRYESMPYPEFKAQVEAWIPCIVPTRTVSRTATGSLLKDTVYPYVGVDDRGKDLYRRNGKIEPASTLWKDGSGGCKLYDGAYGLMAVFDESMKKSGSWRFDPIYYIDVPNVRQDFIREFTKGLSIDYWPKVQLKGDERRIFLKQGDVLLQDGCAMRYYMYNVSNGVVNSYSKIGEKSVPLQKTGPLSDESFPKQAKWDSSLTVMQEDCLGLCWLKFLSDRVGQFENSPV

SEQ ID NO: 786 - protein, 1004 aa, Unknown
  Description of Unknown: uncultivated organism with predicted taxonomy: Collinsella
  MG14-112 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRGAIMKALESVMPWETFANEVRAAHGFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 787 - protein, 1002 aa, Unknown; identical to SEQ ID NO: 771
  Description of Unknown: uncultivated organism with predicted taxonomy: Collinsella
  MG14-113 effector

SEQ ID NO: 788 - protein, 1002 aa, Unknown
  Description of Unknown: uncultivated organism with predicted taxonomy: Collinsella
  MG14-114 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQEAHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 789 - protein, 1003 aa, Unknown
  Description of Unknown: uncultivated organism with predicted taxonomy: Collinsella
  MG14-115 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVVYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIEVSKMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 790 - protein, 1002 aa, Unknown
  Description of Unknown: uncultivated organism with predicted taxonomy: Collinsella
  MG14-116 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFETAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCAADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSDGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPSLKDGTYVPKIAKAATGRKAWKAIPQNVLNSAPLEIYLGDLVQIGNQKGRFRGINIATVSWSFVDTLSKLPVKMPTIGRLNNETIPTVIRELLI

SEQ ID NO: 791 - protein, 1003 aa, Unknown
  Description of Unknown: uncultivated organism with predicted taxonomy: Collinsella
  MG14-117 effector
MEITINREIGKLGLPRHLMLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDHLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNEDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHRSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPALKDGTYVPRIAKAHTGRKAWKPVPGSAMKKPPLEIYLGDLVQIGDFVGRFSGYNIDNANWSFVDRLTRIKISCPTVGKLSNDMSPFVVRESPIK

SEQ ID NO: 792 - protein, 1000 aa, Unknown
  Description of Unknown: uncultivated organism with predicted taxonomy: Olsenella sp. KCTC 15699
  MG14-118 effector
MDVTRPYLVLGLDPGIASCGFCLLDMTNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASQIDDYLKILFSTAPIKGNKECKVTYGTIRKDLDISGKSVFKGIAQDKEKDEPFVPKAWRSLRRVLPERLLARMLEDRNLGDAVCEALTFASSEASLIERLSDLGLSDDERDAILAVPFTGKLFKGYGSRSLKALGLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGETSAPSWDSYRARVMAQVKNPRKRANYLNTDLGPETQAKFLARNLNDDRYMSVAVKNYLEDCLLFPEDGHKRHVTAVAGGATGNLRWVWGLNFGEGNVKNRADDRHHAVDAAIIAACSESTVKKVAEASAKGREAFKQLRKSRLADTQPWPTFAAEVAARREFVVPTRMADHGVTGRVFEDTLYHLEGITEDKGKYPLVRAGKNTVKKGNVRINSDGSVKLIDGMAFLRLWLDPTARPNGKVKGKWYAEPVYYADIPAIKAGTYVPRAIVQGIARINWEPIPQMALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 793 - protein, 1005 aa, Unknown
  Description of Unknown: uncultivated organism with predicted taxonomy: Collinsella
  MG14-119 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRQLNDREWALVLYSLCKRRGYIPHGEGNQDKSSEGGKVLSALAANKEAIAETSCRTVGEWLAQQPQSRNRGGNYDKCGTHAQLIEETHILFDAQRSFGSKYASPEFEAAYIEVCDWERSRKDFDHRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCTYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIARAAIGRKAWKLVPDSAMTKPPLEIYLGDLVQIGNFIGRFSGYNIANGSWSFIDRLTKETLSCPSVAKLNNNLFPTIIRESIIMRK

SEQ ID NO: 794 - protein, 1026 aa, Unknown
  Description of Unknown: uncultivated organism with predicted taxonomy: Collinsella tanakaei
  MG14-120 effector
MESLVNREVGGLGKPRYLVMGMDPGIKSCGFALLDLNNQEILEMGSRLFDAPTHPKTKQSMAVIRRGYRSTRRNIDRTQDRLKHCLKTLKRFDVVPEDADKEFFHTVKGDKQPILLRTDGLNRLLTSREWALVLYSLCKRRGYIPHGEGSDSGTSEDGKVLAALKANERAFADAGYRTVGEWLASLPQSRNRGGNYDKCVTHAQLTDEVRTLFEAQRGFGSPVASQELEDAYIEVFDWERSREEFDKRTYGLVGTCSYFPNEKRAARCTLTSEMVAAYGALGNITIVKRDGSTHPLSAVERDQCIDILFAVDPMKGNKTCAVKYGFLRKRLDLESGDYFKGVPLDDEKNREVFKPKGWRSLRSVLHETNRELLVKLHDDRDLADAVMEAVAYSSSVDVLKSQLSSLDLSNGEIESICAMPYSSKVLNGYGNRSKKALDILLGCFEDPDVLSLTDAEDASGLGAVRMQGAAIDKGERLIPYETWIALTGRTNNNPVVIRALSQMRKVVNAVCRKWGVPDEIHVELDRELRLPKKAKDEIAKAKKRNEKDRQRVAAQIAELLGCSADDVKGDYIEKYRLWEEQECFDIYSGEKIEVDRLIREETYTQIDHVLPFSRTGDNSRHNKVLVLARSNQLKREQTPYEWMTSNTEGAPSWDAFKRRVEENKKLSRRKKNFLLEEDLVSKEGEFQSRNMTDTAYMSREVCAYLSDCLQFPDDGLKNHIVPIAGRATAWLRRQWGLNFGATGEKDRSDDRHHATDACVIAACSRSLVIKTAKVMKQTHWQVTRDMTREQRRSARMKALEGTMPWSTFANEVRERWKVTVPTRFVPRKGRGELYGQTVYSYLGVDESGKDLGRKKGSNKKIVMGNAVISKDGKSMVKISEMLCLRLWFDPDAKGRGGKKGRWYSDPVYKADLGVIQSNAYIPRVAKAHRGRKAWSPVPQAALRRSPVVIYLGDVVKVGDVVGRFAGFDIDSANWSFVDCLDGKGIAFPTVGSLTSELRPEVIREKVLGNAEVYRSTQDDGTSSGAD

SEQ ID NO: 795 - protein, 1004 aa, Unknown
  Description of Unknown: uncultivated organism with predicted taxonomy: Collinsella
  MG14-121 effector
MEITINREIGKLGLPRHLVLGMDPGIESCGFALIDTANHEILNLGVRLFDSPTHPKPGQSLAVIRRGFRSTRRNIDRTQARLKHCLQVLKAYDLIPQDATKEYFHTTKGDKQPLKLRVDGLDRLLNDREWALVLYSLCKRRGYIPHGEGNQDKSSEGGKVLSALAANKEAIAETSCHTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSAMERDECIAILFSCEPIRGNKDCAVKFGALRKALDLSSGDYFKGIPAADEKTREVYKPKGWRVLRNTLNAANPILLQRLRDDRDLADAVMEAVAYSSALPVLQKQLQGLPLSEAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPQRAKDEIAKANKKNKKNRERIAGQIAELRGCTIDEVTGKQIEKYRLWEEQECFDLYTGAKIEVDRLISDDTYTQIDHILPFSRTGENSRNNKVLVLAKSNQDKREQTPYEWMSHDGAPSWGAFERRVQENQKLSRRKKNFLLEKDLDTKEGEFLARSFTDTAYMSREVCAYLADCLLFPDDGAKAHVVPTTGRATAWLRRRWGLNFGSNGEKDRLDDRHHATDACVIAACSRSLVIKTARINQETHWSITRGMNEAQRRDAIMKALESVMPWETFANEVRAAHDFVVPTRFVPRKGKGKLFEQTVYRYAGVNAQGKDIARKASSDKDIVMGNAVVSADEKSVIKVSEMLCLRLWHDPEAKKGQGAWYADPVYKADIPALKDGTYVPRIAKQNYGRKVWKAIPHSLLIQKPLEIYLGDLIRVGDKLGRYNGYNIAKANWSFVDALTKKEITFPSVGMLSNELRPIVIRESILDN

SEQ ID NO: 796 - protein, 1002 aa, Unknown
  Description of Unknown: uncultivated organism with predicted taxonomy: Olsenella
  MG14-122 effector
MDVTRPYLVLGLDPGIASCGFCLLDMTNHKILEMGSHLFKAPQEDKTKTSLAVTRRKARSIRRNTARTAARLKRCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKVLFASQRAHGNTKATRELEDSYLACLTWEKKSLDHDARVYELVGPCSYFPGEKRAASADISSELCRAYERLGHIVIVHEDGSEQALTASEIDDHLKILFSTAPIKGNKECKVTYGTIRKDLDISGKSVFKGIAQDREKDEPFAPKAWRSLRRVLPEGLLARMFADRKLGDAVCEALTFASSEASLIERLSDLGLSDDERDAILAVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVMAQVKNPRKRANHLNTDLGPETQAKFLARNLNDDRYMSVAVKNYLEDCLLFPEDGRKRHVTAVAGGATGNLRWVWGLNFGEGNVKDRADDRHHAVDAAIIAACSESTVKKVAEASAKGREAFKQLRKSRLADTQPWPTFAAEVAARREFVVPTRMADHGVTGRAFQDFSYRLEGLRETGYAEISRQTDPATRERRSDAAGNYALSSNGTVKLLDAIAFVRFWHDPDAGKNGKWYAEPVYCADIPAIQNGSYVPKYQKQKVARNSWLPVPDSAMHNEPLVLFQGDVLIIDSHIGRFWTYAIGGGTLNILSLLDKNEKAECFPPISKWVNSVEVRVLQEDCLGHCYDDISINPEDSTFRQR

SEQ ID NO: 797 - protein, 1003 aa, Unknown
  Description of Unknown: uncultivated organism with predicted taxonomy: Olsenella mediterranea
  MG14-123 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKHASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKTSSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 798 - protein, 1005 aa, Unknown
  Description of Unknown: uncultivated organism with predicted taxonomy: Collinsella
  MG14-124 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVTYSSALPVLQEQLQGLPLSEAEIEALCRLPYSSKALNGYGNRSKKALDVLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIANANWSFVDRLTKEALGCPTVVKLDNKLAPAIIRESIIMHQ

SEQ ID NO: 799 - protein, 1003 aa, Unknown
  Description of Unknown: uncultivated organism with predicted taxonomy: Collinsella
  MG14-125 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALADNKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKVEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVITVREMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 800 - protein, 969 aa, Unknown
  Description of Unknown: uncultivated organism with predicted taxonomy: Libanicoccus massiliensis
  MG14-126 effector
MDSEQPPYTLGHDRDEWQEIKKHLTNRPYLVLGLDPGISSCGFCLIDFNNHLILEMGSHLFKAPQQDKNNVSLAVVRRNARSTRRNNRRTAARLSHCLALLKEAGLVPNDVDKAWLQTRKGDKPVTKLRAVGLDRPLSDREFAQVLYSLCGKRGYIPHGEGRAGETDDAEGKKVLKAIADNTKAMESGGYRTVGEMLYRSDKGRSRNRGGNYDLCVYNSQIQDEVKVVFSAQRELGNNRATQELEKSYFECLTWEKKSADHDAKVYELVGPCTYFPEEKRAANADVSSELCRAYERLGHLVIVHEDGAEQTLTSEQIDKYIGILFSPSPIRGNKDCKVTYNTIRKDLDISAKSMFKGVAKEKEKDEVFAPKAWRKLRIILPTSLLTSMIEDRSFGDDICEAIAYSSTEETLSERLETIDLSEDDRETLLSVPFTSKLFKGYGNRSRKALDLLIGAFEEPEIRTLTEAEVATGLKGKRDEGRFPRSTLLPPYNAYDETCRNPVVLRAMGRMRRIINSIIKIYGVPDEIHVELARELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTLLDEDTQEGFINRNLNDTRYMSRAVKSYLEDCLIFPKGKREKHVTAVAGGATGNLRWVWGLNFGAHGEKNRKDDRHHAVDAAVIAACNESAVMKVAKTTSMGREQFRKERKARLSNTQPWPTFADEVAAIRELVIPTRMVSHGVTGRMFEDTLYHIDDYTQDRGKYPLVRAKGKQNKGGNIRFISDDTAQKIDGIAFLRLWLDPDAPATGQTRGKWYAEPVYYADIPSIKHGDYVPRAIEQDVARINWQPIPESAKSSGPITVYPGDVVLVDNRAARFSKIGITKC

SEQ ID NO: 801 - protein, 1003 aa, Unknown
  Description of Unknown: uncultivated organism with predicted taxonomy: Collinsella
  MG14-127 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 802 - protein, 1003 aa, Unknown
  Description of Unknown: uncultivated organism with predicted taxonomy: Collinsella
  MG14-128 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALVANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 803 - protein, 1003 aa, Unknown; identical to SEQ ID NO: 799
  Description of Unknown: uncultivated organism with predicted taxonomy: Collinsella
  MG14-129 effector

SEQ ID NO: 804 - protein, 753 aa, Unknown
  Description of Unknown: uncultivated organism with predicted taxonomy: Olsenella sp. KH3B4
  MG14-130 effector
MDVTRSYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKK

SEQ ID NO: 805 - protein, 985 aa, Unknown
  Description of Unknown: uncultivated organism with predicted taxonomy: Collinsella
  MG14-131 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRMAKPPLEIYFDDLVQIGDFIERFSGYNINSANWSFTDRLTRLNLSCPTVGQLNNDLSPVVIRESPIK

SEQ ID NO: 806 - protein, 1003 aa, Unknown
  Description of Unknown: uncultivated organism with predicted taxonomy: Collinsella
  MG14-132 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCKLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLINDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 807 - protein, 1004 aa, Unknown
  Description of Unknown: uncultivated organism with predicted taxonomy: Collinsella
  MG14-133 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 808 - protein, 1003 aa, Unknown; identical to SEQ ID NO: 712
  Description of Unknown: uncultivated organism with predicted taxonomy: Collinsella
  MG14-135 effector

SEQ ID NO: 809 - protein, 1004 aa, Unknown
  Description of Unknown: uncultivated organism with predicted taxonomy: Collinsella
  MG14-136 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNREKDCSDDRHHATDACVIAACSRSLVIKTARINQETHWSITRGMNETQRRNAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 810 - protein, 1024 aa, Unknown
  Description of Unknown: uncultivated organism with predicted taxonomy: Clostridiales
  MG14-137 effector
MMEYSDPRDFGFRPETVMTALMPYEQFSSKTRRLILGIDMGIASVGVCLIDIRNHEIVLMASHIFKAPVEGKQKDISARQSGASIRRGYRSVRRTTKRRKNRKKAVRDIEKKYILIPDDADGQWFAIRKGEPDVLHLRGKALLYKLNGRELARILYAFAGRRGYIDHGKGATDDDSGKVKKALSVNRKILDENGYETIAQYLLKQPTSRNREGDYRYMVDIEMVTDEVHTIFRHQRDLGSDIATEELEGEYLSALRWLTDTSARDKKIYSRVGYCTYLGAPEKRAASSLISFEMVRAYEKLSNIKIEHQGREATYISPEKRNEIVASLFAVSKNPKPLKWSQLREKLDMQSSDSFDSRLPTDEKDDCIKIPAWNALCTGLFMSNRALLDRFHDDTDAADAVCSALTYASSGGSLRNALENLSLDLSEQDIDSLLDLPYASKLFSGYCSAGVRALQMLRDAFKDPQIEKLYNAEKATGLYEARQALAAARNESRDGLLCPYLEFDPTCTNPVVLRATAQVRRMINSIIRHYGLPDIIRVEVAKDLKRSKREKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGEEEQKFIDRNLNDTRYMSRQLAMWVRECLPFPDDKRQHVFCVAGAATSLMRRIWGIGIVDEKGKKDRSDDRHHAVDAAVIACCDQRIVKGIARVNSGRSNIKERERLRYESMPYPEFKAQVEAWIPCIVPTRTVSRTATGSLLKDTVYPYVGVDDRGKDLYRRNGKIEPASTLWKDGSGGCKLYDGAYGLMAVFDESMKKSGSWRFDPIYYIDVPNVRQDFIREFTKGLSIDYWPKVQLKGDERRIFLKQGDVLLQDGCAMRYYMYNVSNGVVNSYSKIGEKSVPLQKTGPLSDESFPKQAKWDSSLTVMQEDCLGLCWLK

SEQ ID NO: 811 - protein, 1003 aa, Unknown
  Description of Unknown: uncultivated organism with predicted taxonomy: Collinsella
  MG14-138 effector
MEITINREIGKLGLPRHLVLGMDPGIASCGFALIDTANHEILDLGVRLFDSPIHPKTKQSLAVIRRGFRSTRRNIDRTQARLKHCLQVLKAYGLIPQDATKEYFHTTKGDKQPLKLRVDGLDRLLNDREWALVLYSLCKLRGYVPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 812 - protein, 1003 aa, Unknown
  Description of Unknown: uncultivated organism with predicted taxonomy: Collinsella
  MG14-139 effector
MEITINREIGKLGLPRHLVLGMDPGIASCGFALIDTANHEILDLGVRLFDSPTHPKTGQSLAVIRRGFRSARRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 813 - protein, 1003 aa, Unknown
  Description of Unknown: uncultivated organism with predicted taxonomy: Collinsella
  MG14-140 effector
MEITINREIGKLELPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 814 - protein, 1000 aa, Unknown; identical to SEQ ID NO: 730
  Description of Unknown: uncultivated organism with predicted taxonomy: Olsenella sp. KH3B4
  MG14-141 effector

SEQ ID NO: 815 - protein, 1004 aa, Unknown
  Description of Unknown: uncultivated organism with predicted taxonomy: Collinsella
  MG14-142 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPNLLQRLRDDRDLADAVMEAVAYSSALPVLQERLQGLPLSEAEIEALCMLPYSSKVLNGYGNRSKKALDMLLDCLEEPEVLNLTQGENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 816 - protein, 1005 aa, Unknown; identical to SEQ ID NO: 798
  Description of Unknown: uncultivated organism with predicted taxonomy: Collinsella
  MG14-143 effector

SEQ ID NO: 817 - protein, 1045 aa, Unknown
  Description of Unknown: uncultivated organism with predicted taxonomy: Collinsella
  MG14-144 effector
MDKAQGVDIGELGFDPGTFATALMTLEEFRSKDRVIWAGIDIGVASTGLCLVDVRNHEIVLMTSHLFKSPVVDKKKATAAPESLASVRRGARSVRRNIMREGRRKKAIRAVLADSDLIPADADGEWFAARRDERTVVKLRSKALGHLLNSRELARVLYSFASHRGYIDHGKSDKDDDAGKVKKALAANHAALAGGGCETFGQYLAGQPRSRNRAGDYSFTSDIGMTVDEVRTIFLRQREMGSEIATEALEERYIAELTWLTDTSKRDMSTYLKVGFCTYRGAPYRRGATSTTSFEMVRAHQTLANTVILHEDGTSSTIPGNTRIEIVRELFAVKKSVKPLKWSGLRRRLGLSDGDSFKGRPLEEEKRDCIALPAWAVLCSGLYEDHRDLLERLHDHIEDADAVCSALTYASSAASLAGRLAPLALTDDEVEAIIDLPYSARLFSGYASASLEALQMLRGTLEDPCVTSLRQAEEDSGLAQARAMLAEEHGEAADGLLCAFSDYDPTCKNPVVLRATAQVRRMVNSVIRHYGLPDVIRVEVARDLKRSKHEREIVAESNRARHELNEQAKRDIVEFLGLHDDDHVRGRDLDMVKLYREQGGKDPYTGTGIDFGRMLEERGYVEIDHILPISRTCDNSQANKVLCLTKSNRDKSNRSPYEWMTSGEATAPDWDEFCGRMERWAKMCEPRRYARKKLANLTCENLAERAGGFIDRNLNDTRYMSVALAKWLRECLPFARDGHEHVFCVAGGATALMRSVWDIGITGPDGKKNRDDDRHHAVDAAVIACCTPGIVKNVALVNEGHARADVRQRLFRDSLPYPEFKEQVNAWIPCIVPTLTLPNTVTGSVLKDTVYPYLGRDDAGKDLYLTVKRDKDGRIVDRKVNKATTMWKDGQGGCRAYGSMCALDAVFDASVGKRGKWSFDPVYCIDIPHREDEIRTIRAFSKERAIDLWDSIKVPEDAQRMRIRRGDVLVCDGKAARFYCFDISVNAIRLYSQRGGKQLQTTGPLSSEAFPPPSKWGDDIRVMQEDCLGLCWLSFLSNRAIAQMD

SEQ ID NO: 818 - protein, 1000 aa, Unknown
  Description of Unknown: uncultivated organism with predicted taxonomy: Olsenella sp. KCTC 15699
  MG14-145 effector
MDVTRPYLVLGLDPGIASCGFCLLDMTNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 819 - protein, 1000 aa, Unknown
  Description of Unknown: uncultivated organism with predicted taxonomy: Olsenella
  MG14-146 effector
MDTTRPYLVLGLDPGIASCGFCLLDMTNHKILEMGSHLFKAPQEDKTKTSLAVTRRKARSIRRNTARTAARLKHCLELLAGAGLVQADADKPWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGTEQALTAGEINDYLKILFSTAPIKGNKECKVTYGTIRKDLDISGKSVFKGIAQDKEKDEPFAPKAWRSLRRVLPERLLARMLEDRNLGDAVCEALTFASSEASLIERLSDLGLSDDERDAILAVPFTGKLFKGYGSRSLKALRLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSCTCDDSRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRTDDRHHAVDAAIIAACSESTVKKVAEASAKGREAFKQLRKSRLADTQPWPTFAAEVAARREFVVPTHMANHGVTGRVFEDTLYHLEGITEDKGKYPLVRAGEKTVKKGNVRINPDGSVKLIDGMAFLRLWLDPTARPNGKVKGKWYAEPVYYADIPAIKAGTYVPRACTIHVARVNWEPVPEAAMELEPVVLYAGDVVEINNQLVRYSGFNINGATLYYQSLLNGATTTAIPSLGTWGKDTQVRVLQEDCLGHCYDGILINPEDSTFQKR

SEQ ID NO: 820 - protein, 1002 aa, Unknown; identical to SEQ ID NO: 711
  Description of Unknown: uncultivated organism with predicted taxonomy: Olsenella sp. KH3B4
  MG14-147 effector

SEQ ID NO: 821 - protein, 828 aa, Unknown
  Description of Unknown: uncultivated organism with predicted taxonomy: Olsenella mediterranea
  MG14-148 effector
LIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPIVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIV

SEQ ID NO: 822 - protein, 1003 aa, Unknown
  Description of Unknown: uncultivated organism with predicted taxonomy: Collinsella
  MG14-149 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDCEWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGISRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 823 - protein, 863 aa, Unknown
  Description of Unknown: uncultivated organism with predicted taxonomy: Collinsella
  MG14-150 effector
MEITINREIGKLGLPRHLVLGMDPGITSCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRDNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACNRSLVIKTARINQETHWSITRGMNETQRRDAIMKALESVMPWETFANEVRAAHDFVVPTRFVPRKGKGELFEQTVYRYAGVNAQGKDIARKASSDKDIVMGN

SEQ ID NO: 824 - protein, 1003 aa, Unknown; identical to SEQ ID NO: 822
  Description of Unknown: uncultivated organism with predicted taxonomy: Collinsella
  MG14-151 effector

SEQ ID NO: 825 - protein, 1005 aa, Unknown; identical to SEQ ID NO: 688
  Description of Unknown: uncultivated organism with predicted taxonomy: Collinsella
  MG14-152 effector

SEQ ID NO: 826 - protein, 1005 aa, Unknown; identical to SEQ ID NO: 695
  Description of Unknown: uncultivated organism with predicted taxonomy: Coriobacteriales
  MG14-153 effector

SEQ ID NO: 827 - protein, 1000 aa, Unknown; identical to SEQ ID NO: 733
  Description of Unknown: uncultivated organism with predicted taxonomy: Olsenella
  MG14-154 effector

SEQ ID NO: 828 - protein, 1000 aa, Unknown; identical to SEQ ID NO: 710
  Description of Unknown: uncultivated organism with predicted taxonomy: Olsenella
  MG14-155 effector

SEQ ID NO: 829 - protein, 1024 aa, Unknown
  Description of Unknown: uncultivated organism with predicted taxonomy: Libanicoccus massiliensis
  MG14-156 effector
MDSEQPPYTLGHDRDEWQEIKKHLTNRPYLVLGLDPGISSCGFCLIDFNNHLILEMGSHLFKAPQQDKNNVSLAVVRRNARSTRRNNRRTAARLSHCLALLKEAGLVPNDVDKAWLQTRKGDKPVTKLRAVGLDRPLSDREFAQVLYSLCGKRGYIPHGEGRAGETDDAEGKKVLKAIADNTKAMESGGYRTVGEMLYRSDKGRSRNRGGNYDLCVYNSQIQDEVKVVFSAQRELGNNRATQELEKSYFECLTWEKKSADHDAKVYELVGPCTYFPEEKRAANADVSSELCRAYERLGHLVIVHEDGAEQTLTSEQIDKYIGILFSPSPIRGNKDCKVTYNTIRKDLDISAKSMFKGVAKEKEKDEVFAPKAWRKLRIILPTSLLTSMIEDRSFGDDICEAIAYSSTEETLSERLETIDLSEDDRETLLSVPFTSKLFKGYGNRSRKALDLLIGAFEEPEIRTLTEAEVATGLKGKRDEGRFPRSTLLPPYNAYDETCRNPVVLRAMGRMRRIINSIIKIYGVPDEIHVELARELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTLLDEDTQEGFINRNLNDTRYMSRAVKSYLEDCLIFPKGKREKHVTAVAGGATGNLRWVWGLNFGAHGEKNRKDDRHHAVDAAVIAACNESAVMKVAKTTSMGREQFRKERKARLSNTQPWPTFADEVAAIRELVIPTRMVSHGVTGRMFEDTLYHIDDYTQDRGKYPLVRAKGKQNKGGNIRFISDDTAQKIDGIAFLRLWLDPDAPATGQTRGKWYAEPVYYADIPSIKHGDYVPRAIEQDVARINWQPIPESAKSSGPITVYPGDVVLVDNRAARFSKIGITKCQLTMLNLLSKERVTDWPSIGSWRQDTEVRVLGEDCLGHCYKHIAITRDSSTYRVE

SEQ ID NO: 830 - protein, 1003 aa, Unknown
  Description of Unknown: uncultivated organism with predicted taxonomy: Collinsella
  MG14-157 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 831 - protein, 1005 aa, Unknown; identical to SEQ ID NO: 693
  Description of Unknown: uncultivated organism with predicted taxonomy: Collinsella
  MG14-158 effector

SEQ ID NO: 832 - protein, 1003 aa, Unknown; identical to SEQ ID NO: 768
  Description of Unknown: uncultivated organism with predicted taxonomy: Collinsella
  MG14-159 effector

SEQ ID NO: 833 - protein, 1003 aa, Unknown; identical to SEQ ID NO: 732
  Description of Unknown: uncultivated organism with predicted taxonomy: Collinsella
  MG14-160 effector

SEQ ID NO: 834 - protein, 1003 aa, Unknown; identical to SEQ ID NO: 732
  Description of Unknown: uncultivated organism with predicted taxonomy: Collinsella
  MG14-161 effector

SEQ ID NO: 835 - protein, 1002 aa, Unknown; identical to SEQ ID NO: 701
  Description of Unknown: uncultivated organism with predicted taxonomy: Olsenella
  MG14-162 effector

SEQ ID NO: 836 - protein, 1003 aa, Unknown; identical to SEQ ID NO: 732
  Description of Unknown: uncultivated organism with predicted taxonomy: Collinsella
  MG14-163 effector

SEQ ID NO: 837 - protein, 1000 aa, Unknown; identical to SEQ ID NO: 684
  Description of Unknown: uncultivated organism with predicted taxonomy: Olsenella
  MG14-164 effector

SEQ ID NO: 838 - protein, 1005 aa, Unknown; identical to SEQ ID NO: 688
  Description of Unknown: uncultivated organism with predicted taxonomy: Collinsella
  MG14-165 effector

SEQ ID NO: 839 - protein, 1003 aa, Unknown; identical to SEQ ID NO: 755
  Description of Unknown: uncultivated organism with predicted taxonomy: Collinsella sp. AM17-1
  MG14-166 effector

SEQ ID NO: 840 - protein, 1003 aa, Unknown; identical to SEQ ID NO: 717
  Description of Unknown: uncultivated organism with predicted taxonomy: Collinsella
  MG14-167 effector

SEQ ID NO: 841 - protein, 1000 aa, Unknown; identical to SEQ ID NO: 694
  Description of Unknown: uncultivated organism with predicted taxonomy: Olsenella sp. KH3B4
  MG14-168 effector

SEQ ID NO: 842 - protein, 1000 aa, Unknown
  Description of Unknown: uncultivated organism with predicted taxonomy: Olsenella
  MG14-169 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLVERLSDLDLSGDKQDAILTVPFTAKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 843 - protein, 839 aa, Unknown; identical to SEQ ID NO: 708
  Description of Unknown: uncultivated organism with predicted taxonomy: Olsenella sp. KH3B4
  MG14-170 effector

SEQ ID NO: 844 - protein, 1001 aa, Unknown; identical to SEQ ID NO: 707
  Description of Unknown: uncultivated organism with predicted taxonomy: Coriobacteriia bacterium
  MG14-171 effector

SEQ ID NO: 845 - protein, 1003 aa, Unknown; identical to SEQ ID NO: 740
  Description of Unknown: uncultivated organism with predicted taxonomy: Collinsella
  MG14-172 effector

SEQ ID NO: 846 - protein, 1003 aa, Unknown; identical to SEQ ID NO: 749
  Description of Unknown: uncultivated organism with predicted taxonomy: Collinsella
  MG14-173 effector

SEQ ID NO: 847 - protein, 856 aa, Unknown
  Description of Unknown: uncultivated organism with predicted taxonomy: Collinsella
  MG14-174 effector
EGSQDKSSEGGKVLSALAANKKALAETPCRTVGEWFAQQPQSRNRGGNYDKCVTHAQLIDETHILFEAQRSFGSAFASPEFEAAYIEVCDWERSRKDFDRRSYDLVGRCSYFPAEKRAARCTLTSELVAAYGALGNITIIHEGGTSRALSATERDECIAILFSCEPIRGNKDCAVKFGALRKALDLSSGDYFKGVPAADEKTREVYKPKGWRTLRNTLNAANPILLQRLRDDRDLADAVMEAVAYSSALPVLQEQLQELPLSEAEIEALCKLPYSSKTLNGYGNRSKKALDMLLDCLEEPEVLNLTQAENDCGLLGLRIAGAQLERSDRLMPYETWVELTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSIIRGMNETQRRDAIMKALESVMPWETFANEVRVAHDFVVPTRFVPRKGKGELFEQTVYRYAGVNAQGKDIAHKASSDKDIVMGNAVVSADEKSVIKVSEMLCLRLWHDPKAKKGQGAWYADPVYKADIPALKDGTYVPRIAKAHTGRKAWKPVPESATKKPPLEIYLGDLVQIGDFVGRFSGYNIDNANWSFVDRLTRIKTSCPTVGKLSNDMSPFVVRESPIK

SEQ ID NO: 848 - protein, 1003 aa, Unknown; identical to SEQ ID NO: 714
  Description of Unknown: uncultivated organism with predicted taxonomy: Collinsella
  MG14-175 effector

SEQ ID NO: 849 - protein, 1003 aa, Unknown; identical to SEQ ID NO: 714
  Description of Unknown: uncultivated organism with predicted taxonomy: Collinsella aerofaciens
  MG14-176 effector

SEQ ID NO: 850 - protein, 1003 aa, Unknown; identical to SEQ ID NO: 734
  Description of Unknown: uncultivated organism with predicted taxonomy: Collinsella
  MG14-177 effector

SEQ ID NO: 851 - protein, 1000 aa, Unknown
  Description of Unknown: uncultivated organism with predicted taxonomy: Olsenella sp. GAM18
  MG14-178 effector
MDATRPYLVLGLDPGIASCGFCLLDMTNHKILEMGSHLFKAPQEDKTKTSLAVTRRKARSIRRNTARTSARLKHCLELLAGAGLVPADADKTWLQTKKGDKPILKLRAGGLDRLLTDREFAQVLYSLCGHRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHTVIVHEDGSEQALTAGEIDGYLKILFSTAPIKGNKECKVTYGTIRKDLDISGKSVFKGIAQDKEKDEPFAPKAWRSLRRVLPERLLARMLEDRNLGDAVCEALTFASSEASLIERLSDLDLSDDERDAILTVPFTGKLFKGYGSRSLKALGLLLGAFEEPEIRILTDAEKVTGLLDLRLSDRDVRGQLLPPYSSYDPTCRNPVVLRAMGRMRHIVNAIFRIHGIPDEIHIELGRDLKMSNKEKILVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVIAQVKNPRKRANYLNTDLGPETQAKFLARNLNDDRYMSVAVKNYLEDCLLFPEDGRKRHVTAVAGGATGNLRWVWGLNFGEGNIKDRTDDRHHAVDAAIIAACSESTVKKVAEASAKGREAFKQLRKSRLADTQPWPTFATEVAARREFVVPTRMADHGVTGRVFEDTLYHLEGIAEGKGKYPLVRASEKTVKKGNVRINPDGSVKLIDGMAFLRLWLDPTARPNGKVKGKWYAEPVYYADIPAIKAGTYVPRACTIHVARVNWEPVPEAAMGANPVIVFFGDVLSVDNHVGRFGGFDIFGGRLALLNLLTKQEVSDWPSLGSWGKDTQVRVLQEDCLGHCYDSIAINPEGSTFQQR

SEQ ID NO: 852 - protein, 1003 aa, Unknown; identical to SEQ ID NO: 718
  Description of Unknown: uncultivated organism with predicted taxonomy: Collinsella
  MG14-179 effector

SEQ ID NO: 853 - protein, 1003 aa, Unknown; identical to SEQ ID NO: 791
  Description of Unknown: uncultivated organism with predicted taxonomy: Collinsella
  MG14-180 effector

SEQ ID NO: 854 - protein, 1000 aa, Unknown; identical to SEQ ID NO: 745
  Description of Unknown: uncultivated organism with predicted taxonomy: Olsenella
  MG14-181 effector

SEQ ID NO: 855 - protein, 1003 aa, Unknown; identical to SEQ ID NO: 797
  Description of Unknown: uncultivated organism with predicted taxonomy: Olsenella mediterranea
  MG14-182 effector

SEQ ID NO: 856 - protein, 1002 aa, Unknown; identical to SEQ ID NO: 788
  Description of Unknown: uncultivated organism with predicted taxonomy: Collinsella
  MG14-183 effector

SEQ ID NO: 857 - protein, 1002 aa, Unknown; identical to SEQ ID NO: 796
  Description of Unknown: uncultivated organism with predicted taxonomy: Olsenella
  MG14-184 effector

SEQ ID NO: 858 - protein, 1003 aa, Unknown; identical to SEQ ID NO: 752
  Description of Unknown: uncultivated organism with predicted taxonomy: Collinsella
  MG14-185 effector

SEQ ID NO: 859 - protein, 1002 aa, Unknown; identical to SEQ ID NO: 770
  Description of Unknown: uncultivated organism with predicted taxonomy: Collinsella
  MG14-186 effector

SEQ ID NO: 860 - protein, 1003 aa, Unknown; identical to SEQ ID NO: 764
  Description of Unknown: uncultivated organism with predicted taxonomy: Coriobacteriales
  MG14-187 effector

SEQ ID NO: 861 - protein, 1003 aa, Unknown; identical to SEQ ID NO: 806
  Description of Unknown: uncultivated organism with predicted taxonomy: Collinsella
  MG14-188 effector

SEQ ID NO: 862 - protein, 1003 aa, Unknown; identical to SEQ ID NO: 717
  Description of Unknown: uncultivated organism with predicted taxonomy: Collinsella
  MG14-189 effector

SEQ ID NO: 863 - protein, 1003 aa, Unknown
  Description of Unknown: uncultivated organism with predicted taxonomy: Collinsella
  MG14-190 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDVLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 864 - protein, 1003 aa, Unknown; identical to SEQ ID NO: 802
  Description of Unknown: uncultivated organism with predicted taxonomy: Collinsella
  MG14-191 effector

SEQ ID NO: 865 - protein, 1003 aa, Unknown; identical to SEQ ID NO: 760
  Description of Unknown: uncultivated organism with predicted taxonomy: Collinsella
  MG14-192 effector

SEQ ID NO: 866 - protein, 1003 aa, Unknown; identical to SEQ ID NO: 777
  Description of Unknown: uncultivated organism with predicted taxonomy: Collinsella
  MG14-193 effector

SEQ ID NO: 867 - protein, 1004 aa, Unknown; identical to SEQ ID NO: 729
  Description of Unknown: uncultivated organism with predicted taxonomy: Olsenella
  MG14-194 effector

SEQ ID NO: 868 - protein, 1003 aa, Unknown; identical to SEQ ID NO: 714
  Description of Unknown: uncultivated organism with predicted taxonomy: Collinsella
  MG14-195 effector

SEQ ID NO: 869 - protein, 1046 aa, Unknown; identical to SEQ ID NO: 739
  Description of Unknown: uncultivated organism with predicted taxonomy: Collinsella
  MG14-196 effector

SEQ ID NO: 870 - protein, 1003 aa, Unknown; identical to SEQ ID NO: 801
  Description of Unknown: uncultivated organism with predicted taxonomy: Collinsella
  MG14-197 effector

SEQ ID NO: 871 - protein, 1003 aa, Unknown
  Description of Unknown: uncultivated organism with predicted taxonomy: Collinsella
  MG14-198 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHRSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPALKDGTYVPRIAKAHTGRKAWKPVPGSAMKKPPLEIYPGDLVQIGDFVGRFSGYNIDNANWSFVDRLTRIKISCPTVGKLSNDMSPFVVRESPIK

SEQ ID NO: 872 - protein, 862 aa, Unknown; identical to SEQ ID NO: 747
  Description of Unknown: uncultivated organism with predicted taxonomy: Collinsella
  MG14-199 effector

SEQ ID NO: 873 - protein, 833 aa, Unknown; identical to SEQ ID NO: 721
  Description of Unknown: uncultivated organism with predicted taxonomy: Collinsella
  MG14-200 effector

SEQ ID NO: 874 - protein, 1003 aa, Unknown; identical to SEQ ID NO: 813
  Description of Unknown: uncultivated organism with predicted taxonomy: Collinsella
  MG14-201 effector

SEQ ID NO: 875 - protein, 1003 aa, Unknown; identical to SEQ ID NO: 799
  Description of Unknown: uncultivated organism with predicted taxonomy: Collinsella
  MG14-202 effector

SEQ ID NO: 876 - protein, 1003 aa, Unknown; identical to SEQ ID NO: 799
  Description of Unknown: uncultivated organism with predicted taxonomy: Collinsella
  MG14-203 effector

SEQ ID NO: 877 - protein, 1003 aa, Unknown
  Description of Unknown: uncultivated organism with predicted taxonomy: Collinsella
  MG14-204 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPIVGQLNNDLSPVVIRESPIK

SEQ ID NO: 878 - protein, 958 aa, Unknown
  Description of Unknown: uncultivated organism with predicted taxonomy: Olsenella mediterranea
  MG14-205 effector
MEITINREIGKLGLPRHLVLGMDPGIASCGFALIDTANHEILDLGVRLFDSPTHPKTGQSLAVIRRGFRSTRRNNDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTNELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDTFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPSLKDGTYVPKIAKAATGRKAWKAIPQSVLNSAPLEIYLGDLVQIGNQKGR

SEQ ID NO: 879 - protein, 762 aa, Unknown
  Description of Unknown: uncultivated organism with predicted taxonomy: Collinsella
  MG14-206 effector
MEITINREIGKLGLPRHLVLGMDPGIASCGFALIDTANHEILDLGVRLFDSPTHPKTGQSLAVIRRGFRSTRRNNDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHACHRCLCDCSM

SEQ ID NO: 880 - protein, 1004 aa, Unknown; identical to SEQ ID NO: 809
  Description of Unknown: uncultivated organism with predicted taxonomy: Collinsella
  MG14-207 effector

SEQ ID NO: 881 - protein, 1000 aa, Unknown; identical to SEQ ID NO: 776
  Description of Unknown: uncultivated organism with predicted taxonomy: Olsenella
  MG14-208 effector

SEQ ID NO: 882 - protein, 1003 aa, Unknown; identical to SEQ ID NO: 738
  Description of Unknown: uncultivated organism with predicted taxonomy: Collinsella
  MG14-209 effector

SEQ ID NO: 883 - protein, 1004 aa, Unknown; identical to SEQ ID NO: 754
  Description of Unknown: uncultivated organism with predicted taxonomy: Collinsella
  MG14-210 effector

SEQ ID NO: 884 - protein, 1002 aa, Unknown; identical to SEQ ID NO: 715
  Description of Unknown: uncultivated organism with predicted taxonomy: Collinsella
  MG14-211 effector

SEQ ID NO: 885 - protein, 1046 aa, Unknown; identical to SEQ ID NO: 769
  Description of Unknown: uncultivated organism with predicted taxonomy: Collinsella
  MG14-212 effector

SEQ ID NO: 886 - protein, 1002 aa, Unknown; identical to SEQ ID NO: 771
  Description of Unknown: uncultivated organism with predicted taxonomy: Collinsella
  MG14-213 effector

SEQ ID NO: 887 - protein, 1002 aa, Unknown; identical to SEQ ID NO: 771
  Description of Unknown: uncultivated organism with predicted taxonomy: Coriobacteriales
  MG14-214 effector

SEQ ID NO: 888 - protein, 798 aa, Unknown
  Description of Unknown: uncultivated organism with predicted taxonomy: Olsenella
  MG14-215 effector
MELVKPYYVLGLDLGPASCGFALIDINNMRILEIGSHLFDAPQENKKQTKVSLAAKRRSARSARRNNQRTKNRQKHCIKLLREAKLIPQDASGVWFQTKKGDRPSLKLRDRGLEERLSDREFAQILYTLSARRGYIPHGEGKLGYSKESSDSDLGKVLKAVSENSNALSNGKSRTVGELLYERGSSRNTAGAYDHCVLNSQIVEEVHALFKAQRDFGNDKASEQLENDYIANLTWEKKTLDIDAASYARVGFCTYFEEEKRAARADYSSELCAAYERLGHLTIVDSDGTETRLDPSRRNRYLSILFSPKALPKNKYCKVRYSDIRRDLDLSSDSAFKGVEADQEKDKEPFEPKAWRCMRENGISENLLERMLSDRDFADAIGEALTYASTKDSLLNQLDTVDLTSAEKESIAGLPFSSKIFKGYGNRSLKALYMLLDAFEDPDILTLADAETATGLKGKRLADNYQRSAFLPLYEIYDNDCNNPVVLRAMSRMRRIVNAIIKIYGVPDEIHIELARELKQSKREKDAISKFQRKKEQANNRYREVAAGILNISPDEVSDRIIEKMAFREQQNDKDAYTGTTINLERLVTDSHYCQVDHVLPYSRTSDNSRNNRVLVLSTTNQNKRERTPFEWMNSGEANAPAWNDYKKHVLANKNYSQRKKQVYLLNENLDSETEAQFISRNLNDTRYMSRATMAFLADTLEYPDDGRKRHVIAVAGSATSALRHVWGLNFGEGNVKDRSDDRHHAVDACVIAACSESTLKKVARARSRGYRSFKKTQESRLSDTQPWPTFADDVIAM

SEQ ID NO: 889 - protein, 1005 aa, Unknown; identical to SEQ ID NO: 744
  Description of Unknown: uncultivated organism with predicted taxonomy: Collinsella
  MG14-216 effector

SEQ ID NO: 890 - protein, 1004 aa, Unknown; identical to SEQ ID NO: 737
  Description of Unknown: uncultivated organism with predicted taxonomy: Collinsella
  MG14-217 effector

SEQ ID NO: 891 - protein, 769 aa, Unknown
  Description of Unknown: uncultivated organism with predicted taxonomy: Olsenella mediterranea
  MG14-218 effector
AAFGALPPKASARRTYDLVGHCSYFPTEKRAARCTLTSELVSAYGALGNITIIHENGTSRALSATERDECIAILFSCEPIRDNKDCAVKFGALRKALDLSSGDYFKGVPAADEKTREVYKPKGWRVLRNTLNATNPILLQRLRDDRDLADAVMEAVAYSSALPVLQEQLQGLPLSEAEIEALCRLPYSSKALNGYGNRSKKALDVLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLSFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 892 - protein, 1003 aa, Unknown; identical to SEQ ID NO: 767
  Description of Unknown: uncultivated organism with predicted taxonomy: Collinsella
  MG14-219 effector

SEQ ID NO: 893 - protein, 985 aa, Unknown; identical to SEQ ID NO: 805
  Description of Unknown: uncultivated organism with predicted taxonomy: Collinsella
  MG14-220 effector

SEQ ID NO: 894 - protein, 1003 aa, Unknown; identical to SEQ ID NO: 789
  Description of Unknown: uncultivated organism with predicted taxonomy: Collinsella
  MG14-221 effector

SEQ ID NO: 895 - protein, 1003 aa, Unknown; identical to SEQ ID NO: 778
  Description of Unknown: uncultivated organism with predicted taxonomy: Collinsella
  MG14-222 effector

SEQ ID NO: 896 - protein, 1053 aa, Unknown
  Description of Unknown: uncultivated organism with predicted taxonomy: Collinsella sp. AM13-34
  MG14-223 effector
VIRLESGMDKAKGADIGELGFDPATFATALMTLEEFRSKDRVIWAGLDIGVASTGLCLVDVRNHEIVLMASHLFKSPVVDKKKATAAPESLASVRRGARSVRRNIMREGRRKKAIRAALADFDLIPADADGEWFSARRDERTVVRLRSKALGYLLNSRELARVLYSFASHRGYIDHGKSDKEDDAGKVKKALAANHAALADGGCKTFGQYLAGQPRSRNRAGDYSYTADIGMTVDEVRTIFARQRELGSEIASKALEERYIAELTWLTDTSKRDRSTYLKVGFCTYLGAPYRRGATSTISFEMVRAHQTLCNTVILHADGTSSTIPGDIRIEIVRDLFAVKKSVKPLKWSGLRRRLGLSEGDSFKGRPVEEEKRDCIALPAWAVLCAGLYEGHRDLLERLHDHIDDADAVCSALTFASSAASLAGRLAPLALSDDEVEAIIDLPYSARLFSGYANASLEALQMLRGTFEDPRVTSLRQAEEDSGLAQARAILAEERGGSADGLLCAFSDYDPTCRNPVVLRATAQVRRMVNSVIRHYGLPDVIRVEVARDLKRSKHEREIVAESNRARLELNEQAKRDIIEFLGLPDDHHVRGRDLALVKLYREQGGKDPYTGAAIDFRRMLEEHRYAEIDHILPVSRTCDDSQANKVLCLTKSNRDKSNRSPYEWMTSGEASAPDWGEFCGRMERWAKMCEPRRYARKKLANLTCENLAERAGNFIDRNLNDTRYMSVALAKWLRECLPFTKDGHEHVFCVAGGATALMRSVWDIGITGPDGKKNRDDDRHHAVDAAVIACCTPGIVRNVALVNEGHARADVRQRLFSDSLPYPEFKEQVDAWIPCIVPTLTLPNTVTGSVLKDTVYPYLGRDEAGKDLYLTVKRDKDGRIVERKVNKATTMWKDGQGGCRAYGSMCALEAVFDASAGKRGRWSFDPVYCIDIPHREAVRRTMRAFSKEKAIDLWDTVAVPEAAPRMTIRRGDVLVCDGKAARFHCFDISVNAIRLFSQRGGKQLQATGPLSAEAFPPPSKWGEGVRIMQEDCLGLCWLSFLAQRAAGVQME

SEQ ID NO: 897 - protein, 1004 aa, Unknown; identical to SEQ ID NO: 742
  Description of Unknown: uncultivated organism with predicted taxonomy: Collinsella
  MG14-224 effector

SEQ ID NO: 898 - protein, 1003 aa, Unknown
  Description of Unknown: uncultivated organism with predicted taxonomy: Collinsella
  MG14-225 effector
MEITINREIGKLGLPRHLVLGMDPGIASCGFALIDTANHEILDLGVRLFDSPIHPKTKQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 899 - protein, 1003 aa, Unknown; identical to SEQ ID NO: 898
  Description of Unknown: uncultivated organism with predicted taxonomy: Collinsella
  MG14-226 effector

SEQ ID NO: 900 - protein, 1005 aa, Unknown; identical to SEQ ID NO: 727
  Description of Unknown: uncultivated organism with predicted taxonomy: Collinsella
  MG14-227 effector

SEQ ID NO: 901 - protein, 1026 aa, Unknown; identical to SEQ ID NO: 794
  Description of Unknown: uncultivated organism with predicted taxonomy: Olsenella
  MG14-228 effector

SEQ ID NO: 902 - protein, 1005 aa, Unknown
  Description of Unknown: uncultivated organism with predicted taxonomy: Olsenella
  MG14-229 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRQLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDHRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCTYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIARAAIGRKAWKLVPDSAMTKPPLEIYLGDLVQIGNFIGRFSGYNIANGSWSFIDRLTKETLSCPSVAKLNNNLFPTIIRESIIMRK

SEQ ID NO: 903 - protein, 1004 aa, Unknown; identical to SEQ ID NO: 774
  Description of Unknown: uncultivated organism with predicted taxonomy: Collinsella
  MG14-230 effector

SEQ ID NO: 904 - protein, 1004 aa, Unknown; identical to SEQ ID NO: 786
  Description of Unknown: uncultivated organism with predicted taxonomy: Collinsella
  MG14-231 effector

SEQ ID NO: 905 - protein, 1003 aa, Unknown; identical to SEQ ID NO: 812
  Description of Unknown: uncultivated organism with predicted taxonomy: Collinsella
  MG14-232 effector

SEQ ID NO: 906 - protein, 1003 aa, Unknown; identical to SEQ ID NO: 734
  Description of Unknown: uncultivated organism with predicted taxonomy: Collinsella
  MG14-233 effector

SEQ ID NO: 907 - protein, 1004 aa, Unknown; identical to SEQ ID NO: 815
  Description of Unknown: uncultivated organism with predicted taxonomy: Collinsella
  MG14-234 effector

SEQ ID NO: 908 - protein, 1002 aa, Unknown; identical to SEQ ID NO: 790
  Description of Unknown: uncultivated organism with predicted taxonomy: Collinsella
  MG14-235 effector

SEQ ID NO: 909 - protein, 1004 aa, Unknown; identical to SEQ ID NO: 807
  Description of Unknown: uncultivated organism with predicted taxonomy: Collinsella
  MG14-236 effector

SEQ ID NO: 910 - protein, 1002 aa, Unknown
  Description of Unknown: uncultivated organism with predicted taxonomy: Collinsella
  MG14-237 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHENGTSRALSATERDECIAILFSCEPIRDNEDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPSLKDGTYVPKIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 911 - protein, 1027 aa, Unknown; identical to SEQ ID NO: 782
  Description of Unknown: uncultivated organism with predicted taxonomy: Atopobium sp. ICM42b
  MG14-238 effector

SEQ ID NO: 912 - protein, 1004 aa, Unknown
  Description of Unknown: uncultivated organism with predicted taxonomy: Collinsella
  MG14-239 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNREKDRSDDRHHATDACVIAACSRSLVIKTARINQETHWSITRGMNETQRRNAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 913 - protein, 1003 aa, Unknown; identical to SEQ ID NO: 772
  Description of Unknown: uncultivated organism with predicted taxonomy: Collinsella
  MG14-240 effector

SEQ ID NO: 914 - protein, 1004 aa, Unknown; identical to SEQ ID NO: 795
  Description of Unknown: uncultivated organism with predicted taxonomy: Collinsella
  MG14-241 effector

SEQ ID NO: 915 - protein, 1003 aa, Unknown; identical to SEQ ID NO: 753
  Description of Unknown: uncultivated organism with predicted taxonomy: Collinsella
  MG14-242 effector

SEQ ID NO: 916 - protein, 1004 aa, Unknown; identical to SEQ ID NO: 766
  Description of Unknown: uncultivated organism with predicted taxonomy: Collinsella
  MG14-243 effector

SEQ ID NO: 917 - protein, 1006 aa, Unknown
  Description of Unknown: uncultivated organism
  MG14-244 effector
MAMRRPYLVLGLDPGIASCGFCLLDLTNHKILLMGVRLFSVPKNRSGVSLAAERRAARSTRRNNHRTKSRLKRCLSILKAAGLVPEDADRGWLQARKKDKPVIKLRAVGLVRILSDRELAQALYSLCEHRGYIPHGEGKEGAADDADGKKVLSAIKKNMEDMDKGGYRTVGEMLYTQGRSRNRGGNYDRCVYNSQIQEEVSSIFAAQRSFGNPKATAELEQEYMECLTSEKSSSGHDRRSYEAVGSCVYFPELKRAAKADISSELCRAYERFGHLVIVHKDGTEQTLTSEQISRYISALFTPSAIQKKVQRITCATIRKDLDISGASVFKGVSHEQEKKEVFDPKAWRCLSKCLAGDHGELLERMWQDRSLGDAVCEALTYSSTEESLEGQLETLDLSEDECRALKAVPFNSKIFKGYGTRSIKALSLLVGAFEDPDVRTLADAEKATGLDMKRAEDRMPRSTKLPPYSVYDPTCKNPVVLRAMGQMRKIVNAIIKEHGVPDEIHIELSRDLKMSKREKDAVAKRQRTNEAANKKRATLAAGILGCEPSEVSHLVIRKLALREEQSDKDIYTGAAIDLQRLVEDDHYCEIGHILPYSRTGMGGWNNEVLVLAASNQKKRERTPYEWMQQDAGKAGVPAWDEYSSRVTATIDNPRKRRNLLCKDTGDEAMNGFLLRDLNDTRYMSVAVKNYLEDCLLFPEDGRKLHVTAVSGGATASLRRVWGLNSNGSDDEKTNSNTMRNSIDAAVIAACSVKTVQAVAKTRSLGRETFRHMRRSRLADTQPWETFADDVIVKCKTVIPTRMAEHGVTGCALNEFVYRIDGFNEKGYAILSRQVDRATRKRGIQVAGNYMPFGESSAKLVGQIAFIRLWHDPDFGKDGRWYVEPVYYNDIPALGNGVYQPKYILSKHPRMEWLPVPEAALSGTPLTLFPGDIIVAGNHIARFKKLDIACQGLGMLNILNEQLAVKNFPTINRWKNDMNIFILQEDCLGKCFNSLDIDSGSSTFTLR

SEQ ID NO: 918 - protein, 1006 aa, Unknown
  Description of Unknown: uncultivated organism with predicted taxonomy: Olsenella
  MG14-245 effector
MEANRPYLVLGLDPGIASCGFCLLDMTDHKILEMGSHLFDAPQEAKTKTSLAVTRRNARSARRNTLRTATRMKHCLALLKGADLVPEDADKAWLQSKKGDKPILKLRANGLDRKLADREFAQVLYSLCGRRGYIPHGEGRLGETDDGEGRKVLSAIKANEATMKRGNYRTVGEMLYANDGKSRNRGGDYSLCVYNSQIKDEVRALFAAQRALGNSKASEGFEKDYIDCLEWEKKTVDHDKRVYELVGACPYFPEEKRAADADISSELCRAYERLGHIAIVHEDGSEQNLTPNQIDGYLDVLFSPLPLKGNKECKVTYGTIRKDLDLSGKDVFKGVAQDGEKGEPFSPKSWRCLRTALYENHEDLLVRMLKDRELGDDICEALTFASTEASLGERLGLLDLTDDEQAALCSSVPFTGKLFKGYGNRSLKALGILLGAFEEPEIRTLTDAERATGLLDLRLADRGLRDNLLPSYSKYDPTCRNPVVLRSMGRMRRIVNAIIRIHGVPDEIHIELGRDLKMSNKEKATVSKNQRANEAANKKWAAKAANILGCSPEEVPGRIVRKLAMREEQGDKDAYTGAAIDLEHLVRDDRYCEIDHILPYSRTCDDSRANKVLVLSKSNQDKRERTPYEWMTSGEPGAPDWDEYRNRVMATVKYARKRANLLNTDLGPNVQAQFLARNLNDDRYMSVAVKNYLEDCLLFPNDGRKKHVTAVAGGATGNLRWVWGLNFGQGNTKDRDDDRHHAVDAAIIAACSESTVKKVAEASSKGRETFKHLRKSRLSDTQPWPTFAEEVAARRAFVVPTRMVNHGVTGRVFEDTLYHLEGFTNDKGKYPLVRAGEKTAKKGNVRIGPDGSVKLIDGMAFLRLWLDPNARPNGKVKGKWYAEPVYYADIPAIKAGTYVPRACTIHVARNAWEPVPESAMQREPVVLFAGDVVEVDGHIGRYSGFNIFGGRITILNLLTKAEVGDWPSLGSWGRDTQVRVLQEDCLGHCYDDIVINPDNSTFRQRE

SEQ ID NO: 919 - protein, 1027 aa, Unknown
  Description of Unknown: uncultivated organism with predicted taxonomy: Coriobacteriales
  MG14-246 effector
MGQQNQEMANARHYLVLGLDPGIASCGFCLLDMTDHKILEMGSHLFDAPQNPKSKQNLSVERRNARSARRNLKRTRDRQKKCLELLKQCGLSPSDADKQWLQSRKGDKPVIKLRASALDRTLTDRELAQVLYSLTGRRGYIPHGEGHLDDVDDAEAGKVLAAVRENQNQMAKKGYRTVGQMLYKEGRSRNRGGDYTLCVLNSQIIDEAKIILDEQRSHGNAILTKMSNGEFEQFTNSYIDCLTWEKKSTKHDERVYSLVGACTYFPEEKRAAEADLSSELCRAYERFGHLVMVDADGTEHRLSAKDRARYLQILFSPVPIRGNKDCKVTYATIRKDLDLSAHVSFKGIEAERENKEEPFSPRRWRKLRACGVPEGLLARMLEDRDLADSIGEALAYASTEESLRDKLSSLDLSDDEINQLAVNVPFAGKLFSGYGSRSLKALHMLLDMFEDESILTLDDAERESGLQALRLADKGHRSLNLLPYDIYDPTCNNPTVLRALGRMRRIVNAIIRIYGVPDEIHIELGKELKQSSKEKKSIAKSNLQNKKDNERIAKTIAELLGCSPDDVRGKQIRRFALREEQGCKDAYTGDSIDLMRMLTEDRYTEIDHILPYSRTCDDSRANKVLVLQKSNQDKKERTPWEWMSDDASKGAPDWEEFKARTLTNHRLSYKKRDHLLNQNLNGQEQSFIDRNLNDTRYMSVAVKDYLEKSLLFPDDGRKSHVIAVAGGATSALRHVWGLNFGADNTKDRSDDRHHAVDAAVIAACSQATVKKVADTSKLGHSEFKRKRESRLADTQPWPTFADEVIARREFVIPTRMANHGVTGSAFEDTIYRYEGIREGKDSLAVLSKSQGKDKPRAVKPSGNYRLDADGGAHLYDGIAFLRFWLDAEARPKGKVKGKWLIEPVYYADIPLIQCGRYIPKYIPAAHLARDQWVEIPESVLATDPVTVFFGDVLYVDGHIGRYSGFNINGLKLTMHSVISGESIAFPPVSSTWSKDSEVRIIEEDVLGRCWTPNIAKLVRLQEAASSS

SEQ ID NO: 920 - protein, 1027 aa, Unknown
  Description of Unknown: uncultivated organism with predicted taxonomy: Coriobacteriales
  MG14-247 effector
MGQQNQEMANARHYLVLGLDPGIASCGFCLLDMTDHKILEMGSHLFDAPQNPKSKQNLSVERRNARSARRNLKRTRDRQKKCLELLKQCGLSPSDADKQWLQSRKGDKPVIKLRASALDRTLTDRELAQVLYSLTGRRGYIPHGEGHLDDVDDAEAGKVLAAVRENQNQMAKKGYRTVGQMLYKEGRSRNRGGDYTLCVLNSQIIDEAKIILDEQRSHGNAILTKMSNGEFEQFTNSYIDCLTWEKKSTKHDERVYSLVGACTYFPEEKRAAEADLSSELCRAYERFGHLVMVDADGTEHRLSAKDRARYLQILFSPVPIRGNKDCKVTYATIRKDLDLSAHVSFKGIEAERENKEEPFSPRRWRKLRACGVPEGLLARMLEDRDLADSIGEALAYASTEESLRDKLSSLDLSDDEINQLAVNVPFAGKLFSGYGSRSLKALHMLLDMFEDESILTLDDAERESGLQALRLADKGHRSLNLPPYDIYDPTCNNPTVLRALGRMRRIVNAIIRIYGVPDEIHIELGKELKQSSKEKKSIAKSNLQNKKDNERIAKTIAELLGCSPDDVRGKQIRRFALREEQGCKDAYTGDSIDLMRMLTEDRYTEIDHILPYSRTCDDSRANKVLVLQKSNQDKKERTPWEWMSDDASKGAPDWEEFKARTLTNHRLSYKKRDHLLNQNLNGQEQSFIDRNLNDTRYMSVAVKDYLEKSLLFPDDGRKSHVIAVAGGATSALRHVWGLNFGADNTKDRSDDRHHAVDAAVIAACSQATVKKVADTSKLGHSEFKRKRESRLADTQPWPTFADEVIARREFVIPTRMANHGVTGSAFEDTIYRYEGIREGKDSLAVLSKSQGKDKPRAVKPSGNYRLDADGGAHLYDGIAFLRFWLDAEARPKGKVKGKWLIEPVYYADIPLIQCGRYIPKYIPAAHLARDQWVEIPESVLATDPVTVFFGDVLYVDGHIGRYSGFNINGLKLTMHSVISGESIAFPPVSSTWSKDSEVRIIEEDVLGRCWTPNIAKLVRLQEAASSS

SEQ ID NO: 921 - protein, 858 aa, Unknown
  Description of Unknown: uncultivated organism
  MG14-248 effector
MAKKGYRTVGQMLYKEGRSRNRGGDYTLCVLNSQIIDEAKIILDEQRSHGNAILTKMSNGEFEQFTNSYIDCLTWEKKSTKHDERVYSLVGACTYFPEEKRAAEADLSSELCRAYERFGHLVMVDADGTEHRLSAKDRARYLQILFSPVPIRGNKDCKVTYATIRKDLDLSAHVSFKGIEAERENKEEPFSPRRWRKLRACGVPEGLLARMLEDRDLADSIGEALAYASTEESLRDKLSSLDLSDDEINQLAVNVPFAGKLFSGYGSRSLKALHMLLDMFEDESILTLDDAERESGLQALRLADKGHRSLNLPPYDIYDPTCNNPTVLRALGRMRRIVNAIIRIYGVPDEIHIELGKELKQSSKEKKSIAKSNLQNKKDNERIAKTIAELLGCSPDDVRGKQIRRFALREEQGCKDAYTGDSIDLMRMLTEDRYTEIDHILPYSRTCDDSRANKVLVLQKSNQDKKERTPWEWMSDDASKGAPDWEEFKARTLTNHRLSYKKRDHLLNQNLNGQEQSFIDRNLNDTRYMSVAVKDYLEKSLLFPDDGRKSHVIAVAGGATSALRHVWGLNFGADNTKDRSDDRHHAVDAAVIAACSQATVKKVADTSKLGHSEFKRKRESRLADTQPWPTFADEVIARREFVIPTRMANHGVTGSAFEDTIYRYEGIREGKDSLAVLSKSQGKDKPRAVKPSGNYRLDADGGAHLYDGIAFLRFWLDAEARPKGKVKGKWLIEPVYYADIPLIQCGRYIPKYIPAAHLARDQWVEIPESVLATDPVTVFFGDVLYVDGHIGRYSGFNINGLKLTMHSVISGESIAFPPVSSTWSKDSEVRIIEEDVLGRCWTPNIAKLVRLQEAASSS

SEQ ID NO: 922 - protein, 1027 aa, Unknown; identical to SEQ ID NO: 920
  Description of Unknown: uncultivated organism with predicted taxonomy: Olsenella
  MG14-249 effector

SEQ ID NO: 923 - protein, 1007 aa, Unknown
  Description of Unknown: uncultivated organism with predicted taxonomy: Olsenella
  MG14-250 effector
MESERAYLVLGLDPGIASCGFCLLDMTNHKILEMGSRLFKTPQEDKTKVSLAVTRRNARSARRNNERTKSRMKHCMDILADEGLIPEDADKTWFQSKKGDKPILKLRSCGLNRALTDREFAQVLYSLCGHRGYIPHGEGKDAETDDAEGKKVLNAIKRNTEEMAAGGYRTVGEMLHSRGKSRNRGGNYDFCVYNSQIQSEVHAIFEAQRALGNLKANEKFEDRYLECLTWEKKSSDHDKKVYDQVGTCIYFPELKRAADADVSSELCRAYEKLGHLVIVHVDGAEQRLTGEQISHYIGILFSPTPLNNNKYCKVTYSTIRSDLDLSGKSVFKGVPQEKEKDEVFVPKAWRCLRKVLANDHEDLLDRMLNDRELGDAICEALTFSSSETSLQEQLEPLGLAEDECVALSSIPFNGKLFKGYGSRSIKALSILLGAFEEPGVQTLADAEKATGLDRKRLEDRVARSELLPPYNTYDETCRNPVVLRAMGQMRHIVNAIIRIYGVPDEIHIELGRELKMSAREKEMVSKRQRANETANKNWAAIAAKILCCEPEEVPGQTIRKLAFREEQGEKDIYTNAPIDLEKLVTDNRYCEIDHVLPYSRTCDDSRANKVLVLSASNQNKRERTPYEWMSQDAGKAGTPKWSEYSARVIATVKNPRKRANLLNMDLDKDAESEFLQRNLNDTRYMSVAVKNYLEDCLQFPDDGRKTHVIAVAGGATASLRHVWGLNFGKNNEKDRTDNRHHAVDAAVIAACSTKTVQAVARASSVGRESFKHIRQSRLADTQPWKTFAEDVITERSFVIPTYMADHGVTGCVFEDFSYSLEGIDEKGYAHISRQTDRTTGECRSLKASNFEIVNETTVKLLDSMAFLRLWHDPHAGKTGRWYIEPVYCADIPNLDGKTYHPRYQKQKVARSGWPLVPAEALKNKPLLLFRGDVLIVGNHIARYWKFDIGGGKVTMLSIVDINSEAKGFPSISKWKNDMPVRILSEDCLASCYKHMTIDSENSTFEER

SEQ ID NO: 924 - protein, 1006 aa, Unknown
  Description of Unknown: uncultivated organism
  MG14-251 effector
MAMQRPYLVLGLDPGIASCGFCLIDLANHKILLMGVRLFSVPKNRAGVSLAAERRAARSARRNNQRTKSRLKRCLTILKAAGLVPEDADRGWLQARKKDKPVIKLRAAGLDRVLSDRELAQVLYSLCEHRGYIPHGEGKEGATDDADGKKVLSAIKKNMEDMAKGGYRTVGEMLCAQGRSRNRGGNYDRCVYNSQIQEEARAIFAAQRSFGNLNVTAELEQEYMECLTSEKSSSDHDRRSYEVVGSCVYFPELKRAAKADISSELCRAYERFGHLVIVHKNGNEQTLTHEQINRYISALFMPSALQKKAQRITYATIRKDLDISGTSVFKGISHEQEKNEVFEPKAWRCLSKCLAENHGELLDRMWLDRALADSVCEALTYASTEVSLKGQLEALDLSEDECRAIKAIPFNSKIFKGYGTRSIKALSLLVGAFEDPDVRTLADAERATGLDMKRAEDRMPRSIMLPPYSAYDPTCRNPVVLRAMGQMRKIVNAIIKDHGVPDEIHIELSRNLKMSKREKDAIAKRQRSNEAANKKWAALAAGILDCEPSEVPHLVIRKLALREEQGDKDVYTGAAIDLERLVADDHYCEIDHILPYSRTGMSGWNNEVLVLAASNQKKRERTPYEWMQQDAGKSGVPAWDAYSSRVAATIGNPRKRRNLLCMDTGQEAMNGFLLRDLNDTRYMSVAIKNYLEDCLLFPEDGRKLHVTAVSGGATASLRRVWGLNTKGSDDEKTNSDTMRNAIDAAVIAACSVKTVQAVAKTRSLGRETFRHMRRSRLADTQPWETFADDVLAKCETVIPTRMAEHGVTGCALNEFVYRIDGFNEKGYAILSRQIDRATGERGVQVAGNYAPFGAGSAKLVGQTAFIRLWHDPDFGKGGRWYVEPVYYKDIPTLHDISYQPRYILSGRPRTEWPPVPEAALSRPPLILFSGDILVVGNHIARFKRLDINSQKLVMLNIFDERSLVKDFPTISRWKGDTNISIFSEDVLGKCFESVDIDSESSTFTLH

SEQ ID NO: 925 - protein, 1000 aa, Unknown
  Description of Unknown: uncultivated organism with predicted taxonomy: Olsenella umbonata
  MG14-252 effector
MAEQYLVLGLDPGISSCGFALLDMNNHKILEMGSHLFDAPQESKTKVSLAVGRRNARSARRNNLRTKNRQKHCMKLLKEAGLVPDDATKQWFQSAKGDRPLLELRFAALERILTNREFAQILYALSARRGYIPHGEGRISKLSDMDTSGSSDAETGKVLKAIGENNKLMVQGQFRTVGEMLYHQGKSRNKGGSYEHCVLNSQIVDEVHAIFQRQRAQQNPAATQELEDKYIENLTWEKRTLDHDARVYALVKKCKYFPSEYHAARADLSSELCSAYERLKHLRIVNADGHETALAPEQVEAYIAILFSPEPLSGRKEKVTYARIRKDLDLSAHLFFKGIDPEDEKDHEPYAPRAWRAMRKVLPTELMNRFRNDRALADAVGEALTYASSEDSLIYQLDSLDLSEAEREYILGLPFSGKIFKGYGSRSLKALGMLIDAFEEPEVTTLTEAEESSGLLGLRMSDNGMRYPLLPPYSTYDSENRNPVVLRAMGRMRRIVNAIIRIYGVPDEIHIELGRDLKRSKHEKDLISKRNRENERKNKQWRAQAAEIQGIDPDEVRPKLLKKMALWEEQGGLDAYTGHKIEFDRMISDDKYCEIDHVLPYSRTCDDSRSNKVLVLAKSNQDKRERTPYEWMTQDAQKGAPSWDEYQARVIANRHISPRKRRYLLNNNLGPDQESDFLNRNLNDDRYMSRAVKSYLEDTLIFPEDGRKKHVTAVSGGATGSLRHVWGLNFGDGNTKDRSDNRHHAVDACVIAACSEATVQAVAKARKLGAEAYKHIREDRLKDTQPWPTFADEVVARREFVIPTRMVSHGVTGQAFEDTNYRFDGLTNDTKKLGILYGNGKFTKKGNYVIGGDGNAHLVDGMAFLRLWIDPTAKKGKGKWYAEPVYYADIPAIKNGTYVPRAGKATVARNAWEAIPEAAHRTKPLVLFCGDVISMDGHTARYWSFSINTLTLKTKDLITGDDYKDFPTLGKWSKDSYPKIIQEDCLGHCYKGLVPKSSEG

SEQ ID NO: 926 - protein, 1022 aa, Unknown
  Description of Unknown: uncultivated organism with predicted taxonomy: Atopobium sp. ICM42b
  MG14-253 effector
MSGQSNGKTILGIDAGIASVGFCLLDIDNHQILELGSRLFDQPTEPKTDQNLSVARRQARSQRRLIARRKVRKGRCLGILKSCGLVPDDVDSGWLQSRKGDKNPLILRAEGLDRRLTDRELAQVLYLLCTHRDYIPHNADKAKTGDAAKDNERGKVLSAVGANRDKLAQLGYRTVGEMFAKEVKDDGNTAHRQGSYRNRRYKDSSGKEQSDYSHTVYMVELVDEVRQIVEAQRAFGNDRLTDSFLDTYLANMTAERGSKEKDAKVYQEQVAYCTYFPQEKRAASATLSNELANAYERLSNLRVINPDGTESCLDGVQIEQFINVLFSVKAPTLNYGKIRKTLDLSSEHYFKGIDRDRESKLEPCAPKAWRALCKSLSEKTLGHKSSLLVKMAVDRGFADTVLEAFAYASDEESFTDRVAELLANKGYDQLTDAELEDALSVPFTSRVFKGYCSRSLKALGLLLGCWEESEVSSLTEAEEASGLLQRRLADSYQRAELLPPYDSYDPTCTNPVVLRALSQMRRVINSIIKIHGIPDEIHVELSRDLKNSKAARDMIAKRQRDREKEKNALRKVIAELLSCELEDVTSNQLFRYELRQEQGDVDVYTGEQIDLMRMLLDQSYTQIDHILPYSRTAIDSRSNKVLVLSGSNAAKGERTPLEWMEEDVGAPDKDQYQSRIHSMSLPAAKKEKLLRRELTDADSRGFLDRNLNDNRYLSRAVMNWLAETLAFGDMDRRHVYAVTGAGTAILRKSWALNFGPNGLKDRNYDRHHAIDAAVIAACSVSTIQAIATAHAHERRLSESRMVSTQPWPSFAIELTQRIERVVPTHQVQHKGTGTVLQATIYGLRGMTKTNKYQIVTSGKTSTSGNLHIHPDGKSAQSIGDMAFLRLWHDSKNGKWYPEPVYYYDLPRLDSDAYVSRYITRNRSRDKWHEVPSEAMNERPLVVHRNDVLVVDGHVGRYITVDIAGGTIDVRSLLSKAKDGNLALATGFPSLSRWKDAWVVNEDCLGHCYDGFIVNSDCLAVIG

SEQ ID NO: 927 - protein, 1007 aa, Unknown; identical to SEQ ID NO: 923
  Description of Unknown: uncultivated organism with predicted taxonomy: Olsenella sp. KH3B4
  MG14-254 effector

SEQ ID NO: 928 - protein, 1000 aa, Unknown; identical to SEQ ID NO: 925
  Description of Unknown: uncultivated organism with predicted taxonomy: Olsenella
  MG14-255 effector

SEQ ID NO: 929 - protein, 800 aa, Unknown
  Description of Unknown: uncultivated organism with predicted taxonomy: Olsenella
  MG14-256 effector
MPEQLHGRTVLGIDAGIASVGFCLLDLDNHQILELGSHLFDQPTEPKTKQNLSVARRQARGQRRLIARRKVRKGRCLGILKDCGLVPADIDASWLQSRKGDKNPLILRAEGLDRRLTDRELAQVLYLLCTHRGYIPHNADKSATGDAARDNELGKVLSAVGSNREKLATSGYRTVGEMFAKEVKDDGVAAHRQGSYRNRRYKDSSGKEQGDYSHTVYMVELVDEVKQLVNAQRTFGNDKLTDAFLEAYLANMTAERGCKEKDAKVYEEQVGYCTYFPQEKRAATASLSNELANAYERFSNLRIINPDGSESRLDGMQIEQFVSALFSVKAPKVTYSKVWKALGLSSQHYFKGIDNDDKSRLEPYTPKAWRALCKSLSEKTLGHKSVLLAKMAYDRDYADAVLEAFAYASDDDSFSDRVNELLANKGYDQLTDAELEEAISVPFTSRVFKGYCSRSLKALGMLLECWEEKEITSLTEAEEASGLDRLRLSDRHERTLLLQPYDVYDPTCRNPVVLRSLSQMRRVINAIIKIHGVPDEIHVELSRDLKNSKAVKDKISNQQRRREAEKATLRRTIAELLQCEPDDVTGGQLLRYELRQEQNDQDVYTGDSIDLMRMLRDQSYTQIDHILPYSRTAIDSRSNKVLVLASSNAAKGERTPLEWMEQDANGPSIDAYQSRVHALNLPSAKKEKLLRRELTEDDAKHFLDRNLNDNRYLSRSVMNWLADTLAFDNLGHRHVYAVTGAGTAILRRHWALNFGSNGLKDRNDDRHHAIDAAVIAACSVSTIQSIATAHARGYRSSESR

SEQ ID NO: 930 - protein, 1082 aa, Unknown
  Description of Unknown: uncultivated organism with predicted taxonomy: Megasphaera
  MG15-1 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 931 - protein, 1113 aa, Unknown
  Description of Unknown: uncultivated organism with predicted taxonomy: Selenomonas sp. AE3005
  MG15-3 effector
MNYILGLDIGIASVGWAAVALDANDEPYKILDLNSRIFEKAEDPQNGDSLAAPRRKARGSRRRTRRRRHRMERLRHLFAREGLLSADKIEEIFHVPDDVYRLRAEGLTRCLKDEEWARVLYHIAKHRGFKSNRKSAASDADEGKVIEAVRQNAVLLKNYKTVGEMLFRDEKFQAAKRNKGGSYNFCVSRDMLSDEIGALFEAQRKAGNQHASEKFEADYHKIFADQRNFDDGPDINSHSPYAGNQIENMIGNCSLEPSEKRAPKASYSFMRFALLQKINHLRLKKAKGEERFLNDEERAAVEELAWKTASLTYGAVRKALSLSDEWRFTDLYYRWGKTQEEIEKKKLQFTVPYHEIRKALDKREKGRIQKLTPDALDAIGYIFTVFKNDAKIAEALKSAGIGEEDAAALMAAGLTFSGFGHISVKACRKLIPNFEKGMTYDKACKEEGYEFQGKSGEKTKFLSGNLEEIREIPNPVVRRAIAQTVKVINAVIRRYGSPVGVNVELAREMGRTFQARRDMMKSMEDNSAKNEKLKEELKGYGVMHPSGLDIVKLKLYKDQGGVCAYSLAAMPIEKVFKEHDYAEVDHILPYSRSFDDSYSNKVLVLTKENRDKGNRTPMEYMANMPGRKHDFITWVNSSIRDFRKRDNLLLENFDEEREDAWKERHLTDTQYISRFVKNLLDEHLEFAPWLSGKKQHVIAVNGAVTDYTRKRLGIRKIREDGDLHHAVDAAVIATVTQGNIQKLTNYSKRIECACIKNSDGSYTNPDTGEILKKDELIVQMSKHFPEPWPKFRHELEARVSDHPKELIESLKLPSYSMEEIDALKPPFVSRMPTRKVRGAAHLETVVSPRLQNEGMILKKVPLESLKLTKEKDAIENYYAPESDRLLYEALLHRLQAFEGNGKKAFAEEFHKPKADGMPGPVVKKVKVAEKSTLSVPVHQGKGLAANGGMVRIDVFFIPEGRELGYYLVPVYTSDVVRGELPMRAVVAHKSYAEWKIMREEDFLFSLYPNDLIWIENKKGIKVNLPNKLAKNSSLTASRVQKEGFFYYKGMNIANAQFDVVVHDGTYRQESLGVKTLTKMEKWTIDVLGGEVNQVSREQRQGFNDMKRDPHAIK

SEQ ID NO: 932 - protein, 1113 aa, Unknown
  Description of Unknown: uncultivated organism with predicted taxonomy: Selenomonas sp. AE3005
  MG15-4 effector
MNYILGLDIGIASVGWAAVALDANDEPYKILDLNSRIFEKAEDPQNGDSLAAPRRKARGSRRRTRRRRHRMERLRHLFAREGLLSADKIEEIFHVPDDVYRLRAEGLTRCLKDEEWARVLYHIAKHRGFKSNRKSAASDADEGKVIEAVRQNAVLLKNYKTVGEMLFRDEKFQAAKRNKGGSYNFCVSRDMLSDEIGALFEAQRKAGNQHASEKFEADYHKIFADQRNFDDGPDINSHSPYAGNQIENMIGNCSLEPSEKRAPKASYSFMRFALLQKINHLRLKKAKGEERFLNDEERAAVEELAWKTASLTYGAVRKALSLSDEWRFTDLYYRWGKTQEEIEKKKLQFTVPYHEIRKALDKREKGRIQKLTPDALDAIGYIFTVFKNDAKIAEALKSAGIGEEDAAALMAAGLTFSGFGHISVKACRKLIPNFEKGMTYDKACKEEGYEFQGKSGEKTKFLSGNLEEIREIPNPVVRRAIAQTVKVINAVIRRYGSPVGVNVELAREMGRTFQARRDMMKSMEDNSAKNEKLKEELKGYGVMHPSGLDIVKLKLYKDQGGVCAYSLAAMPIEKVFKEHDYAEVDHILPYSRSFDDSYSNKVLVLTKENRDKGNRTPMEYMANMPGRKHDFITWVNSSIRDFRKRDNLLLENFDEEREDAWKERHLTDTQYISRFVKNLLDEHLEFAPWLSGKKQHVIAVNGAVTDYTRKRLGIRKIREDGDLHHAVDAAVIATVTQGNIQKLTNYSKRIECACIKNSDGSYTNPDTGEILKKDELIVQMSKHFPEPWPKFRHELEARVSDHPKELIESLKLPSYSMEEIDALKPPFVSRMPTRKVRGAAHLETVVSPRLQNEGMILKKVPLESLKLTKEKDAIENYYAPESDRLLYEALLHRLQAFEGNGKKAFAEEFHKPKADGMPGPVVKKVKVAEKSTLSVPVHQGKGLAANGGMVRIDVFFIPEGREHGYYLVPVYTSDVVRGELPMRAVVAHKSYAEWKIMREEDFLFSLYPNDLIWIENKKGIKVNLPNKLAKNSSLTASRVQKEGFFYYKGMNIANAQFDVVVHDGTYRQESLGVKTLTKMEKWTIDVLGGEVNQVSREQRQGFNDMKRDPHAIK

SEQ ID NO: 933 - protein, 1078 aa, Unknown
  Description of Unknown: uncultivated organism with predicted taxonomy: Veillonellales
  MG15-6 effector
MNYVLGLDVGITSCGWAVLELNHEDEPVRIVDLNSRIFDKAEAGNGDSLAAPRRMARGIRRLTRRRKFRLHRVRGFLVRHHILTKEEIENLYTNPHKTDIYELRYRVLTEKVSPSDWARLLIFFAKHRGFQSNRKNEKSGEDGLMLAAIGENKKILENYRSVGDMLYSDEKFKDCKRNKGGTYRFTVSRSMLKEEVQILFKKQRELGQTFAGEDLEDEYLSIFSAQRNFDEGPGANSPYAGDQIEKMIGDCTFEDGENGRPLQKRAPKASYAFMAFNLWQKINHIRVNSKGIQRSLETEEKNKIADLAWTKENITYHDLRQITGLDEETRFSEVTYPLDSTTEEAEKKVKFSWVKPYHAMRRALDKVEKNYIRKLSREEIDAIAYAFTVYKNDKKIRTALTEKGIKENVADVLITHLDGFSKFGHLSEYACYKLLPFLEKGEEYYKACDSAGLIESPARKIKDITNPVVKRAVTQTMKVIKAVQRKYGNPVEVHIELARELARSFKDRAAMDHRMKENYAKNEKIKERLSKEFHIMNPTGQDIVKWKLYEQQQGCCAYSQKPFDVDRLLHDGNYAEVDHILPYSRSFDDTYRNKVLVLEKENRDKGNRTPMEYLADKPERKEKFIAWVKTVIKDSKKREHLLRVKYGRDEEAEWKQRHLQDTQYISRFLYNYLRNTLKLAPGYTDRKRRIIPVNGAVTGYIRKRLDIRKIRENGDLHHAVDAVVIAVTTQGMIQKVTRYSQIRENPKLIDKKTGEVLTAKEFHNKDNFPEPWPRFRQELEVRVSEDPEEAIRRLRLPAYENVGEIKKPFVSRMPRRKVRGAAHEETVRSGKLREDGYTILKTDLSKLKLENGEIKGYYRPESDRLLYEALKKRLEAFGGKGEEAFKEPFYKPKADGTPGPLVKKVKIIEKSSLNVPVHKGKGVAYNDMMVRIDIFGVNEKGKNAYYFVPVYVSDTVKKELPCRGVVKRKSYENWKIMDDKDFLFSLYHNDMIHVVSKKPLSFTAAKGSSLLPKMETKDTYVYYKGADIKGVSITVINHDNSYGIKGMGIKTLLQLEKCEVDVLGNISFVKQEKRQGFR

SEQ ID NO: 934 - protein, 861 aa, Unknown
  Description of Unknown: uncultivated organism with predicted taxonomy: Megasphaera stantonii
  MG15-7 effector
ADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLKEGGIEKADREALLERLSGFSKFGHLSLKACYKILPFLEKGEVYSRACERAGYDFSKSSLENINDIPNPVVKRSISQTLKVINAIILQYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTATTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 935 - protein, 1084 aa, Unknown
  Description of Unknown: uncultivated organism with predicted taxonomy: Dialister
  MG15-8 effector
MNYVLGLDVGITSCGWAVLELNPEDEPVRIVDLNSRIFDKAEAGNGDSLAAPRRMARGIRRLTRRRKFRLHRVRGFLVRHHILTKEEIENLYTTPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYISIFSAQRNFDEGPGANSPYAGDQIEKMIGNCTFEDGKNDRPPQKRAPKASYAFMAFNLWQKINHIRVNCKGIERSLETEEKNKIAGLAWTKENITYHDLRQITGLDEETRFSGVTYPLDSTTEEAEKKVKFSWVKPYHAMRRALDKVEKNYIRKLSREEIDAIAYAFTVYKNDKKIRTALAEKGIEDNVADVLITHLDGFSKFGHLSEYACYKLLPFLEKGEEYYKACDSAGLTESPAKKIKDITNPVVKRAVTQTMKVIKAVQRKYGNPVEVHIELARELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKERFIAWVKTTIKDSKKREHLLRVKYGRDEEAEWKQRHLQDTQYISRFLYNYLRNTLELAPGYTDRKRRIIPVNGAVTGYIRKRLDIRKIRENGDLHHAVDAVVIAATTQGMIQKVTRYSQIKENETWIDDHTKVDERTGEIFFVKKAHEKDAFPEPWPRFRQELEARVSEDPEEAIRRLGLPSYENAGEIKKPFVSRMPRRKVRGAAHKETVRSGKLREDGYTILKTDLSALKLKNGEIEGYYRPESDRLLYEALKKRLEAFGGKGKEAFKEPFYKPKADGTPGPLVKKVKIIEKSSLNVPVHKGKGIAYNDTMVRIDIFGVNEKGKNAYYFVPVYVSDTVKKELPCRAVVSKKPYEEWKVMDDKDFLFSLYPNDMIHVVAKTPLSFTVAEGADLAPTMETKDTYVYYKKAAISVGTITVITHDNSYGIKSMGIKTLLQLEKCEVDVLGNISFVKQEKRQGFR

SEQ ID NO: 936 - protein, 1081 aa, Unknown
  Description of Unknown: uncultivated organism with predicted taxonomy: Dialister invisus
  MG15-9 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 937 - protein, 1082 aa, Unknown
  Description of Unknown: uncultivated organism with predicted taxonomy: Dialister
  MG15-10 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQCLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 938 - protein, 1082 aa, Unknown
  Description of Unknown: uncultivated organism with predicted taxonomy: Dialister
  MG15-11 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKLYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 939 - protein, 1103 aa, Unknown
  Description of Unknown: uncultivated organism with predicted taxonomy: Megasphaera micronuciformis
  MG15-12 effector
MDTKELKYVVGLDIGITSVGWATLLLDSQDEPVRILDLNSRIFDKAEVPKTGASLAAPRRMARGVRRRLRRRKFRLHRVRQYILRHHILDKVGLECLYKPKTDIDIFALRTAGLDRQLKPEEWARILLYMAKHRGFKSNRKSTADETADGDMLKAIQQNKEILSKYRSVGEMFDKDEKFSDHKRNKGGSYEFTVARSMLEDEIKLLFEKQRDFGSAFAEKDAEEEYIDLFSAQRNFDEGPGGDSPYGGNQIGKMIGLCTFEGKNGEKRAPKASYAFMATNLWQKINQIRIIKKGTELHLTAEEAGKKYEKAWNKEAMTYKDIRSEISLGDEASFKGLAYKWTETDKEETESKTKFSWVKEYHTLRKVLDKVEKNRILQLSHDEIDNIAYVFSVYKNDDKIREALEETDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHMDAHRLFHENNYAEVDHIIPYSRSFDDTYNNKVLVLTAENRQKGNRTPMEYLSGDEARKKQFVAWVKSDVKKPRKRENLLREKFTDDAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENATEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSSGPIVKKCKVLDKINLSVPVHGGKGAAANANGGMIRVDIFKAKGKNGKSSYYAVPIYVADTVKVELPNRAVVTKKTYAEWPEMKTEDFAFSLYPNDVVYIGGKEIKMNVMPGCTLATENHVKDDFFYYKGLDIATGAMIVINHDGTYKQRGVGIKQLPLIEKYEVSVLGDLVKAIYRPREIFKHKAQRSK

SEQ ID NO: 940 - protein, 1081 aa, Unknown
  Description of Unknown: uncultivated organism with predicted taxonomy: Megasphaera sp. AM44-1BH
  MG15-13 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAQEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLGEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETIENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 941 - protein, 1081 aa, Unknown
  Description of Unknown: uncultivated organism with predicted taxonomy: Dialister
  MG15-14 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 942 - protein, 1104 aa, Unknown
  Description of Unknown: uncultivated organism with predicted taxonomy: Megasphaera micronuciformis
  MG15-15 effector
MDTKELKYVVGLDIGITSVGWATLLLDSQDEPVRILDLNSRIFDKAEVPKTGASLAAPRRMARGVRRRLRRRKFRLYRVRQYILRHHILDKAGLECLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLAFTEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFDGKGKDAFKEPFHKPKSDGSPGPIVKKCKVLDKINLAVPVHDGKGITKNAGGSMIRVDIFKVKKSNGGHQYYSVPIYVADTVKEALPNRAVVAYKEYDEWKIVDDKDFVFSLYPNDLLFIGGKEIKLNGTGGDTLHQGIMVQDVFLYYRGLNIAVGSIGVENSDGRYAQDSLGIKQLPIIEKYEVSVLGDLVKAMYRTRETFKHKAQRAK

SEQ ID NO: 943 - protein, 840 aa, Unknown
  Description of Unknown: uncultivated organism with predicted taxonomy: Megasphaera stantonii
  MG15-16 effector
MNYVLGLDIGITSVGWAVLELDTHDEPIRIVDLNSRIFEKAEVPKTGESLAAPRRMARSARRLTRRRRFRLHRMRRYLIRNRILDARQVEELYVDSIGKTDIYELRYQALSQPVSNSDWARLLIFFAKHRGFKSNRKHISDSGDKGQMLNAITENQEILNNYHTVGEMLYKNEKFKACKRNKGGSYAFTVSRDMLADEIHALFDVQRSLGQAYASEELEEEYMELFSAQRNFDEGPGMNSPYSGNQIEKMIGCCTFEDDEKRAPKASYAFMAFNVWQKINHLRVTCEGTDRSLSQAEKETLAALAWKKENITFKDIRNKLGLDDTVRFLDVNYNLDKYKTAEEAEKKVKFSWVKEYHAIRKALDKVKKDRISELSHEQIDTIAYAFTVYKNDEAIKRYLLEHAIELADAEALLENISGFSKFGHLSVKACYKLLKPLKQGNVYTKACEIAGYDPQKSSQGNISDIPNPVVKRALSQALKVIKAIIRQYGCPPVEIHIELARELAKSAKERTELEKAMKDNQSRNEKIKTKLHELNVMQPTGLDIVKYKLYEQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYISRYLYNYLKRHIELKEGYTDRKRRIIPVNGAVTAYVRKRLGISKIRENGDLHHAVDAVIIACVTQGVVNKISRYSKIKELRQFMTADGTIVDQETGEVLQTANPRKTDPFPEPWPKFRQELEARVSDNPAEAIAALRLPTYEGIVTISAPFVSRMPNRKVHGPAHMETIRSAKM

SEQ ID NO: 944 - protein, 1082 aa, Unknown
  Description of Unknown: uncultivated organism with predicted taxonomy: Dialister
  MG15-17 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 945 - protein, 1103 aa, Unknown
  Description of Unknown: uncultivated organism with predicted taxonomy: Megasphaera micronuciformis
  MG15-18 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSASDASDDGDMLDAIRKNKEVLSKYRSVGEMFDKDEKFSDHKRNKGGSYEFTVARSMLEDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEIGLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQAMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKVRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFYKPKSDGSLGPIVKKCKVIDKISLAVPVHGGKGATANANGSMIRVDIFRVKEKNNKHSYYAVPIYVADTVKDKLPNKAIVAKKNYDEWLEMKKEDFVFSLYPNSAVYIGGKDIKMNVISGCTLELEKTMRDTILYYKGLDISPGALKIINHDGTYQQRGLGIKSLPFIEKYEVSVLGDLVKATYRPRETFNHKAQRSK

SEQ ID NO: 946 - protein, 1104 aa, Unknown
  Description of Unknown: uncultivated organism with predicted taxonomy: Megasphaera micronuciformis
  MG15-19 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSAAVAGGDDGDMLDAIRKNKEVLSKYRSVGEMFDKDEKFSDHKRNKGGSYEFTVARSMLVDEIKLLFERQRDFGSAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEAYFKGLSYKWTETDKEETESKVKFSLVKEYHTLRKVLDKVEKNRILQLSHDDIDNIAYIFSVYKNDDKIREALEETDLDSKDIDVLIEHLGTFRKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYFSGDEARKKQFVAWVKSDIKKPRKRENLLREKFTADAENDWKIRHLQDTQYISRFMLNYLQNNYELTPGNTDRRRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVIDKISLAVPVHGGKGATANANGSMIRVDIFRVKEKNNKHSYYAVPIYVADTVKDKLPNKAIVAKKNYDEWLEMKKEDFVFSLYPNSAVYIGGKDIKMNVMSGCTLELEKTMRDTILYYKGLDISPGALKIINHDGTYQQRGLGIKSLPFIEKYEVSVLGDLVKATYRPRETFNHKAQRSK

SEQ ID NO: 947 - protein, 1082 aa, Unknown
  Description of Unknown: uncultivated organism with predicted taxonomy: Dialister
  MG15-20 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRNGAYNFTVSRAMLMEEIHTLFEIQRNLGQKFADEKLEEEYVILFAAQRKFDEGPGENSPYAGNQIEKMIGSCTFEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNHILKLSHEQLDTIATAFSVYKNEETIEQYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLILVDAGKEIPFKAALKGSTLDPEKKASRFLMYYKGADIATGSISGVNHDETYKARGVGIQSLREIKKCCIDVLGNISFASKEKRQTFR

SEQ ID NO: 948 - protein, 1081 aa, Unknown; identical to SEQ ID NO: 940
  Description of Unknown: uncultivated organism with predicted taxonomy: Dialister
  MG15-21 effector

SEQ ID NO: 949 - protein, 1082 aa, Unknown
  Description of Unknown: uncultivated organism with predicted taxonomy: Dialister
  MG15-22 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKSKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 950 - protein, 1082 aa, Unknown
  Description of Unknown: uncultivated organism with predicted taxonomy: Dialister
  MG15-23 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKIEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 951 - protein, 1081 aa, Unknown
  Description of Unknown: uncultivated organism with predicted taxonomy: Dialister invisus
  MG15-24 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADSAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGIASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 952 - protein, 1081 aa, Unknown
  Description of Unknown: uncultivated organism with predicted taxonomy: Dialister
  MG15-25 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGIASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 953 - protein, 1082 aa, Unknown
  Description of Unknown: uncultivated organism with predicted taxonomy: Dialister
  MG15-26 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 954 - protein, 1082 aa, Unknown
  Description of Unknown: uncultivated organism with predicted taxonomy: Dialister
  MG15-27 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRGGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRGNGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 955 - protein, 1082 aa, Unknown
  Description of Unknown: uncultivated organism with predicted taxonomy: Dialister
  MG15-28 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEINTLFEIQRNLGQKFADEKLEEEYVILFASQRKFDEGPGENSPYAGNQIEKMIGSCTLEGKKEKRAPKASYVFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIERYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKESIRSGRLKEEGYTISKTALIDLKLTGDKEEIKGYYNKESDRLLYEALKKQLQRYGGKAKEAFKEPFHKPKADGTPGPIVNKVKIMEKSTMLIPVNDGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKVSRFLMYYKGADIATGSISGVNHDETYKARGVGIQSLREIKKCCIDVLGNISFASKEKRQTFR

SEQ ID NO: 956 - protein, 784 aa, Unknown
  Description of Unknown: uncultivated organism with predicted taxonomy: Dialister invisus
  MG15-29 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRY

SEQ ID NO: 957 - protein, 1081 aa, Unknown; identical to SEQ ID NO: 940
  Description of Unknown: uncultivated organism with predicted taxonomy: Megasphaera sp. AM44-1BH
  MG15-30 effector

SEQ ID NO: 958 - protein, 1082 aa, Unknown
  Description of Unknown: uncultivated organism with predicted taxonomy: Dialister
  MG15-31 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGEKSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEQYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKRTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIINKVSRYSKSRELWDYEVDMETGEVLQKKNKNTKDVFPEPWLNFRYELEQKVRVRPLNIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 959 - protein, 1082 aa, Unknown; identical to SEQ ID NO: 953
  Description of Unknown: uncultivated organism with predicted taxonomy: Veillonellales
  MG15-32 effector

SEQ ID NO: 960 - protein, 1081 aa, Unknown
  Description of Unknown: uncultivated organism with predicted taxonomy: Dialister
  MG15-33 effector
MNYVLGLDVGIASVGWAVLELNEEDNPIRIEGLGARIFDKAEVPKTGASLAAPRRMSRGIRRVIRRRRFRLQRVRSYFKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALNKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIAGGTINGVNHDSTYGIRIGLQRLKGIRKCRIDVLGNISLVGKEKRKTFR

SEQ ID NO: 961 - protein, 1081 aa, Unknown; identical to SEQ ID NO: 951
  Description of Unknown: uncultivated organism with predicted taxonomy: Megasphaera
  MG15-34 effector

SEQ ID NO: 962 - protein, 1084 aa, Unknown
  Description of Unknown: uncultivated organism with predicted taxonomy: Megasphaera
  MG15-35 effector
MNYVLGLDIGITSVGWAVLELDTHDEPIRIVDLNSRIFEKAEVPKTGESLAAPRRMARSARRLTRRRRFRLHRVRRYLIRNRILDARQVEELYVDSIGKTDIYELRYQALSQPVSNSDWARLLIFFAKHRGFKSNRKHISGSGDEGQMLNAITENQEILKNYRTVGEMLYKNEKFKACKRNKGGSYTFTVSRAMLADEIHTLFDVQRNLGQAYASEKLKEEYMELFSAQRNFDKGPGINSPYSGNQIEKMIGSCTFEDGEKRAPKASYAFMAFNVWQKINHLRVTCEGTYRFLSQTEKETLAALAWKKENITFKDIRRELKLDDTVRFLDVNYNLDKYKEEAEKKVKFSWVKEYHAIRKALDKVKKDRISELSHEQIDTIAYAFTVYKNDEAIKRYLLEHAIELADAEALLENISGFSKFGHLSVKACYKLLEPLQQGHVYTKACEIAGYDPQKSNQENINDIPNPVVKRALSQALKVIKAIIRQYGCPPVEIHIELARELAKSAKERTELEKAMKDNQSRNEKIKTKLHELNVMQPTGLDIVKYKLYKQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYISRYLYNYLKRHIELKEGYTDRKRRIIPVNGAVTAYVRKRLGISKIRENGDLHHAVDAVIIACVTQGVVNKISRYSKIKELRQFMTADGTIVDQETGEVLQTANPRKTDPFPEPWPKFRQELEARVSDNPAEAIAALRLPTYEGIVTISAPFVSRMPNRKVHGPAHMETIRSAKMQQDGYTMVKTELTNLKLKDGEIEGYYNPSSDKILYDALKRRLEQFGGDGNKAFKDPFYKPKSDGTPGPEVKKVKIMTKSSLNVAVNQGKGVADNGSMVRIDVFGVEERGKNAYYFVPIYVADTVRETLPNKAVVPNKSYNDWKFMRDEDFLFSLYPNDLIYIESLSPVSFHTVKGCTLVPKIERKEMLLYYRKAGISTASITVLNHDNTYVKESLGIKTIGKLQKCTVDILGNVHYVQKEKRLGFK

SEQ ID NO: 963 - protein, 1081 aa, Unknown; identical to SEQ ID NO: 952
  Description of Unknown: uncultivated organism with predicted taxonomy: Dialister
  MG15-36 effector

SEQ ID NO: 964 - protein, 1081 aa, Unknown; identical to SEQ ID NO: 952
  Description of Unknown: uncultivated organism with predicted taxonomy: Dialister
  MG15-37 effector

SEQ ID NO: 965 - protein, 1112 aa, Unknown
  Description of Unknown: uncultivated organism with predicted taxonomy: Selenomonas bovis
  MG15-38 effector
MDRRYALGLDIGIASVGWAVLAFDDADNPYRIINMGTRIFDAAEHPKDGASLAAPRREARSARRRLRRRHHRIERTRKLLIREGLLTKDALQHLFDAPPEKDVYTLRFEGLECCLDGEEWARVLLFFSKHRGFRSNRIVDDEAGDEGKVLSAIRQNEERLQGYRTVGEMLARDPKFADRKRNKAEDYQLTVSRTMLEKEICTLFDAQRQWKNPHASEDFEQEYLEIFSSQRHFDEGPGGRSPYGGDQIEKMIGRCTLEPKEKRAPKASYSFQRFSLLQNINHLRIKSQNTERSLSDEERKAVEALCWKSPSVTYYKIRQEVNLPDDVRFAGLYYDKAPEEVEKKTKFSYTVPYHEIRKVLDKWKKGGIQELDVHQLDTIGYAFTVYKNDDRIHRYLCGHGISDAIAEVLVQNLKSFQKFGHISLKACQKLIPFLEQGMVYSDACKAAGYAAPDAEPKKFLSGGMEEIREIPNPVVRRSLSQTVKIINAVIREYGSPVEVHIELAREMARSRQDRDKMEKDIKNNRARNEAIKKELQELGLRNPKGQDIIKWRLYKEQDGFCAYSQKQFDVERLLHDGSYAEIDHILPYSRSFDDSYHNKVLVMAAENRQKGNRTPLEYMAGEEERIHAFRIWVNSRIHDFRKRQNLLREHFDKESTEKDWKERNLNDTKYISRFIYNLIRQHLQFAPFRTDRKQHIISVNGAVTSYIRKRLGIPKIREDGDLHHAVDAVVIASITQGTIQKVTRYSREKETLYHCDSKGRLIDTSTGEILSPEEHQRRLAEKFPEPWPCFRKEIEARISHHPAENLRLLHLPTYTEEELAELEKPIFVSRMPNHKVRGAAHEKSLRSPRLQEDGIIVYSTPLTKLKLGKDNNSILNYYNPDSDRLLYTALLQRLQKFQGDAEKAFKEPFHKPKADGTLGPVVRKVKVTDKSNLNVSLNHGHSIAKNDSDGGMVRVDVYYIPDGKKHGYYLVPVYVSDVVRKTLPNKAIVADTPYAEWPEMREEDFLFSLYKNDLIHLRKKKPAKMKVIQKESTLQKEIAVSEGNAYYISTDSATASIKIINHDNTYYTKGLGVKTLLSLEKMQVDVLGNITPAPREPRQDFSAMKRDRFARK

SEQ ID NO: 966 - protein, 1082 aa, Unknown; identical to SEQ ID NO: 953
  Description of Unknown: uncultivated organism with predicted taxonomy: Dialister
  MG15-39 effector

SEQ ID NO: 967 - protein, 1082 aa, Unknown; identical to SEQ ID NO: 953
  Description of Unknown: uncultivated organism with predicted taxonomy: Dialister
  MG15-40 effector

SEQ ID NO: 968 - protein, 1089 aa, Unknown
  Description of Unknown: uncultivated organism with predicted taxonomy: Megasphaera sp. AM44-1BH
  MG15-41 effector
MHYVLGLDIGITSVGWAVLELNIQDEPIRIVDLNSRIFERAEIPKTGESLAAPRRVARSSRRRTRRRRFRLYRIRRYLLRNQIITPSDMKILYDNCGDMKDIYTLRHEALDRAVTSKEWARLLIFFGKHRGFKSNRKSIIASGDEGVMLQAVKENQELLKAYRTVGDMLYSDTKFANAKRNKGESYTFTVSRRMLTDEIQTLFCIQRDLGQSFATPSLEDEYLSIFLAQRNFDEGPGGNSPYSGNQIEKMIGNCAFEKNEKRAPKASYAFMAFNLLQKINHLRIERKGKQRFLTQEERNNIAGLAWKKENLTFKDIRTAISLSGDELFQDVHYASEVSLEECEKKTKFNLVRSYHAMRKALDAVEKNRIQKLSHEQLDTIAYAFTVYKNDDKISSYLLAHSIEQQDVEALLAQLRTFNKFGHLSIKACYRILPYLKEGKTYAAACTSAGYDFRNSSLEEIKDIPNPVVKRAVSQTLKVIRAIIKKYGCEPVEIHIELARELARSFQNRVKMQKSMEENQSRNEKIKERLVQEYNILSPTGMDIVKFKLYEQQQGACAYSQKMFNIYQLFHDPSYAEVDHIIPYSRSFDDSYRNKVLVFTAENRNKGNRTPMEYLKNQSERKEQFITWVKNTIRDYKKRNNLLRETYTSEDEADWKRRHLQDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEILTLKHVHKKDPFPEPWPHFRQELEARVGKQPQEAIAALHLPTYKNVESIYTPFVSRMPNRKVHGPAHLETIRSSKLLYKGITIVKTSLTNLKLKDGEIQGYYNPDSDRILYQALKRRLIQFDGEGRAAFKEPFYKPRSDGSPGPMVKKVKIMTNSSLNVLLNHGRGVADNGAMVRIDVFYVSEKGKKAYYFVPIYVADTVKKELPHKAVVAYKPCEEWKNVDDDDFIFSLYPNDLVYVRHKKSILLKASKRSTLSPQIKIKEGLFYYKGANISVGSISIINNDDTYGQHSLGIKTLECMKKANVDILGNVTFVGRENRQPFQLSKK

SEQ ID NO: 969 - protein, 898 aa, Unknown
  Description of Unknown: uncultivated organism with predicted taxonomy: Veillonellales
  MG15-42 effector
GEEKRALFEGQPQWGQAYAAEELEKEYIEIFGAQRNFDEGPGAGSPYGGDQIEKMIGTCTFEPMEKRAPKVSYGFMAFNLWQKINHLGLIANGVAPSFTAEEKQQIADLAWSKNNLHLQHIRKELRIPEDTIFSGVNYGIRKQDTEWAKQLEEVEKKQKFNWLTPYHEMRVALDAVKKHRITELSPDQIDTIAYAFTVFKNDEKITSYLRENGIEEDDIRALLSKVKGFSKFGHLSLKACYKILPYLEEGNIYSKACELAGYDFRSSSQEQLEDIPNPVVKRAISQTLKVIKAIVRRYGNPVEVHIELARELARNFEDRRTMQKSMEDNQKRNEEIKERLVKEYNVLQPTGMDIVKFKLYEEQQGACAYSQKMFDVNRVLHDPSYSEVDHIIPYSRSFDDSYNNKVLVLTKENRDKGNRTPMEYLKDNPVRIDAFTTWVNAIVRNSRKRANLLKSSFTEDAEQEWKRRHLQDTQYISRFLYNYLRQNLPLKEGFTNRKRRIIPVNGAVTSYVRKRLGIAKIRENGDLHHAVDAVIIACVTQGVIKRVSEYSKSRELWLYQLDDGTVIDGETGEVMTGQRGHKQEPFPEPWPEFRHELEDRVSENPPELLRHLQLPAYEGIDIETIKTPFVSRMPNRKVKGQAHEETIRSGRLKYEGYTVTKVDLKNLKLKNGEIEGYYNPDSDRLLYNALKQQLEVYDGKGDKAFAEPFHKPKADGTPGPIVKKVKIMTKSNLNVPVNGGKGVADNGSMVRIDVFGVEERGKMAYRFIPIYVSDTVKRILPNKAVTRDRGYKDWDIMDDKDFLFSLYPNDLIYVESKRDISLKAAKGSTLAKERKQKEALVYYRGADIATASIGVVNDDNTYSMRGLGIKTLQSIRKCIVDVLGNVAFVTKEKRQGFR

SEQ ID NO: 970 - protein, 1082 aa, Unknown
  Description of Unknown: uncultivated organism with predicted taxonomy: Veillonellales
  MG15-43 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 971 - protein, 898 aa, Unknown; identical to SEQ ID NO: 969
  Description of Unknown: uncultivated organism with predicted taxonomy: Veillonellales
  MG15-44 effector

SEQ ID NO: 972 - protein, 1112 aa, Unknown; identical to SEQ ID NO: 965
  Description of Unknown: uncultivated organism with predicted taxonomy: Selenomonas bovis
  MG15-45 effector

SEQ ID NO: 973 - protein, 1081 aa, Unknown
  Description of Unknown: uncultivated organism with predicted taxonomy: Dialister
  MG15-46 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADEKLEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEENLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 974 - protein, 1078 aa, Unknown
  Description of Unknown: uncultivated organism with predicted taxonomy: Dialister
  MG15-47 effector
MNYVLGLDVGITSCGWAVLELNHEDEPVRIVDLNSRIFDKAEAGNGDSLAAPRRMARGIRRLTRRRKFRLHRVRGFLVRHHILTKEEIENLYTNPHKTDIYELRYRALTEKVSPSDWARLLIFFAKHRGFQSNRKNEKSGEDGLMLAAIGENKKVLENYRSVGDMLYSDEKFRDCKRNKGGTYRFTVSRSMLKEEVQTLFKTQRELGQTFAGEDLEDEYISIFSAQRNFDEGPGANSPYAGDQIEKMIGDCTFEDGKNGRPPQKRAPKASYAFMAFNLWQKINHIRVNSKGIERSLETEEKNKIAGLAWTKENITYYDLRQITGLDEETRFSGVTYPLDSTTEEAEKKVKFSWVKPYHAMRRALDKVEKNYIQKLSREEIDAIAYAFTVYKNDKKIRTALAEKGIEDNVADVLITHLDGFSKFGHLSEYACYKLLPFLEKGEEYYKACDSAGLTESPAKKIKDITNPVVKRAVTQTMKVIKAVQRKYGNPVEVHIELARELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKEKFIAWVKTTIKDSKKREHLLRVKYGRDEEAEWKQRHLQDTQYISRFLYNYLRNTLELTPGYTDRKRRIIPVNGAVTGYIRKRLGIRKIRENGDLHHAVDAVVIAVTTQGMIQKVTRYSQIRENPKLIDKKTGEVLTAKEFHNKDNFPEPWPRFRQELEARVSEDPEEAIRRLRLPAYENVGEIKKPFISRMPRRKVRGAAHEETVRSGKLREDGYTILKTDLSKLKLENGEIKGYYRPESDRLLYEALKKRLEAFGGKGEEAFKEPFYKPKADGTPGPLVKKVKIIEKSSLNVPVHKGEGAAYNKIRIRIDIFGVNEKGKMAYYFVPVYVSDTVKRELPCRAVVQDKSYENWKMMDDKDFLFSLYPNDMIHVVAKRDLSFTAAEGSSLAPKMKTKDAYVYYKGADINGGTITVINHDNSYGIKSMGIKTLLQMEKCEVDILGNISVVKQEKRQGFR

SEQ ID NO: 975 - protein, 1112 aa, Unknown; identical to SEQ ID NO: 965
  Description of Unknown: uncultivated organism with predicted taxonomy: Selenomonas bovis
  MG15-48 effector

SEQ ID NO: 976 - protein, 1081 aa, Unknown
  Description of Unknown: uncultivated organism with predicted taxonomy: Dialister
  MG15-49 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 977 - protein, 1082 aa, Unknown
  Description of Unknown: uncultivated organism with predicted taxonomy: Dialister
  MG15-50 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRNGAYNFTVSRAMLMEEIHTLFEIQRNLGQKFADEKLEEEYVILFAAQRKFDEGPGENSPYAGNQIEKMIGSCTFEGKKEKRAPKESYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNHILKLSHEQLDTIATAFSVYKNEETIEQYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 978 - protein, 1082 aa, Unknown; identical to SEQ ID NO: 938
  Description of Unknown: uncultivated organism with predicted taxonomy: Dialister
  MG15-51 effector

SEQ ID NO: 979 - protein, 1081 aa, Unknown
  Description of Unknown: uncultivated organism with predicted taxonomy: Veillonellales
  MG15-52 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRVPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 980 - protein, 1081 aa, Unknown; identical to SEQ ID NO: 952
  Description of Unknown: uncultivated organism with predicted taxonomy: Dialister invisus
  MG15-53 effector

SEQ ID NO: 981 - protein, 1081 aa, Unknown
  Description of Unknown: uncultivated organism with predicted taxonomy: Dialister
  MG15-54 effector
MNYVLGLDVGIASVGWAVLELNEEDNPIRIEGLGARIFDKAEVPKTGASLAAPRRMSRGIRRVIRRRRFRLQRVRSYFKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIAGGTINGVNHDSTYGIRIGLQRLKGIRKCRIDVLGNISLVGKEKRKTFR

SEQ ID NO: 982 - protein, 768 aa, Unknown
  Description of Unknown: uncultivated organism with predicted taxonomy: Megasphaera stantonii
  MG15-55 effector
AGGDDGVMLKAIQQNKEVLSKYRSVGEMFDKDEKFSDHKRNKGGSYEFTVARSMLIDEIKLLFEKQRDFGSAFAEKDAEEGYIDLFSAQRNFDEGPGGDSPYGGNQIEKMIGLCTFEGKNGEKRAPKASYAFMATNLWQKINQIRIIEKGTERPLTAEEAGKIYEKAWNKEAMTYKDIRSEIGLGDEASFKGLPYKWTETDKEETEGKTKFSWVKEYHTLRKVLDKVEKNRILQLSHDDIDNIAYIFSVYKNDDKIREALEETDLDSKDIDVLIEKLGTFSKFGHLSLKACYKILPYLEQGMVYSDACTAAGYDFKKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDVKKPRKRENLLREKFTADAENDWKVRHLQDTQYISRFMLNYLQNNYELTPGNTNRKRRIIPVNGAVTAYVRKRLGISKIRENGDLHHAVDATVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADG

SEQ ID NO: 983 - protein, 1112 aa, Unknown; identical to SEQ ID NO: 965
  Description of Unknown: uncultivated organism with predicted taxonomy: Selenomonas bovis
  MG15-56 effector

SEQ ID NO: 984 - protein, 1081 aa, Unknown; identical to SEQ ID NO: 981
  Description of Unknown: uncultivated organism with predicted taxonomy: Dialister
  MG15-57 effector

SEQ ID NO: 985 - protein, 1094 aa, Unknown
  Description of Unknown: uncultivated organism with predicted taxonomy: Dialister
  MG15-58 effector
VDIFSKYFVQRREAIYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENIDDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFQAEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 986 - protein, 1081 aa, Unknown; identical to SEQ ID NO: 973
  Description of Unknown: uncultivated organism with predicted taxonomy: Dialister
  MG15-59 effector

SEQ ID NO: 987 - protein, 1081 aa, Unknown; identical to SEQ ID NO: 952
  Description of Unknown: uncultivated organism with predicted taxonomy: Megasphaera
  MG15-60 effector

SEQ ID NO: 988 - protein, 1081 aa, Unknown; identical to SEQ ID NO: 952
  Description of Unknown: uncultivated organism with predicted taxonomy: Dialister
  MG15-61 effector

SEQ ID NO: 989 - protein, 1103 aa, Unknown; identical to SEQ ID NO: 945
  Description of Unknown: uncultivated organism with predicted taxonomy: Megasphaera stantonii
  MG15-62 effector

SEQ ID NO: 990 - protein, 1081 aa, Unknown
  Description of Unknown: uncultivated organism with predicted taxonomy: Dialister
  MG15-63 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRLIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 991 - protein, 1081 aa, Unknown
  Description of Unknown: uncultivated organism with predicted taxonomy: Megasphaera
  MG15-64 effector
MNYVLGLDVGIASVGWAVLELNEEDNPIRIEGLGARIFEKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEENLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 992 - protein, 1082 aa, Unknown; identical to SEQ ID NO: 955
  Description of Unknown: uncultivated organism with predicted taxonomy: Dialister
  MG15-65 effector

SEQ ID NO: 993 - protein, 1103 aa, Unknown
  Description of Unknown: uncultivated organism with predicted taxonomy: Megasphaera micronuciformis
  MG15-66 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSAAVAGGDDGVMLDAIRKNKEVLSKYRSVGEMFDKDEKFSAHKRNKGGSYEFTVARSMLEDEIKLLFEKQRDFGSAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEAYFKGLSYKWTEADKEETESKVKFSLVKEYHTLRKVLDRVEKNRILQLSHDDIDNIAYIFSVYKNDDKIREALEETDLDSKDIDVLIEHLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRILYEALKKRLEQFGGKGKDAFKEPFHKPKSDGSPGPIVKKCKVLDKINLAVQVHGGNGATSNANGSMIRVDIFKVKEKNDKSSYYAVPIYVADTVKSELPKKAVCQKPYDEWPEMKEADFAFSLYPNDVIYIGGKELKMNAVLGCTLETTRSMQDVNLYFKGMDISTGAIQVVNHDGTYKQRSLGIKQLPLIEKCEVSVLGDLVKAQYRPRETFKHKAQRSK

SEQ ID NO: 994 - protein, 1053 aa, Unknown
  Description of Unknown: uncultivated organism with predicted taxonomy: Megasphaera stantonii
  MG15-67 effector
APRRMARGVRRRLRRRKFRLHRVRQYILRHHILDKAGLECLYKPKMDIDIFALRTAGLDRLLEPEEWARILLYMAKHRGFKSNRKSTAVAGGDDGIMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTHLDSKDIDVLIENLGTFSKFGHLSLKACYNILPYLEQGMVYSDACTAAGYDFRKSAQGSIADIPNPVVKRAISQTMKVLKAIKQKYGCPPVEIHIEMARELAKSFDERQKMAKSIEENQSHNERIKERLQKEFNVPYPSGQDIVKLKLYEEQNETCAYSQKHMDAHRLFHEDNYAEVDHIIPYSRSFDDTYNNKVLVLTAENRQKGNRTPMEYLSGDEARKKQFVAWVKSDIKKPRKRENLLREKFTTDAENDWKIRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVLDKINLAVQVHGGKGITKNAGGSMVRVDVFKVKKSNGGHQYYLVPIYVADTVKERLPNRAVMAHKEYDEWKIVDDKDFVFSLYPNDLLFIGGKEIKLNGTGGDTLHQGIMVQNVYLYYRGLNIAVGTISVEDHDSKYIQESLGVGRVPVLEKYEVSVLGDLIKAQYRPRETFKHKAQRTKDQVNV

SEQ ID NO: 995 - protein, 1081 aa, Unknown
  Description of Unknown: uncultivated organism with predicted taxonomy: Veillonellaceae bacterium DNF00626
  MG15-68 effector
MNYVLGLDVGIASVGWAVLELDEKDEPIRIIDLSSRIFDKAEVPRTGASLAQARRIARGVRRRLRRRRFRLHRVRSYLIRQSILTKEELQNIYHCSHEESIYELRYKGLSEKLSATNWGRLLLFFAKHRGFRSNRKNDQSKEDGLMLKAISENEELLKKYRTVGEMIYSDEKFKEYKRNKGGNYQFTVSRSMLIDEIKMLFETQRKLGQFFAEQELEEKYLDIFSAQRNFDEGPGGNGFYSGNQIEKKIGVCTFEKGENGENPPKRAPKASYAFMAFTLWGKINHLRINSKGTRRALTQEEKEKVAKLSWEKASINFSTIRKELQLSPEDHFIDVRYTYGKTDEECEKGTKWNYCASYHTMRKALDKVYKNRIKELMSEQDEQKQLDDIAYAFTVYKSDEKIKNYLLQCQLEEKDAEALLAGVNNFSGFGHLSNKACYKILLHLKQGYEYAKACEMAGYDFKNISLEDIKDIPNPVVKRAIIQTLKVVRAVVREYGNPVEVHIELARDLGRNFKDRDLIKSNMEKNQKKNDEIKERIVNEFGIMQPKSQDIVKLKLCEQQDNVCVYSQKSFDLHRLFEKNYVEVDHIIPYSRSFDDTYANKVLVFNKENRDKGNKLPLEYLANQPERKEKFIAWVKSHIKDRKKRDNLLRESYSAEDKNGWKQRNLQDTQYISSYLYRYLMQNITLAPGYTDRKERIISLNGVVTGYVRKRWRIPKIRANGDLHHAVDAVVIACINDRLIKRVTEYSKAKELEYTPSDSGAVKTSMKDGFPEPWYCFRQELKARLSETPDEAIRNLHLATYCNVGNIKTPFVSRMLKCKVTGQANKETIGSGRLKDEEYVIEKTLLTELKLDKNNEIEGYYRPEDDKLLYEALKKQLMNHGGKGDKAFQAPFYKPKSDGTPGPLVKKVKLKVKLNSQVHVYQGKGIAQNGDMIRIDVFCVNKKGKKAYYFVPIYVADTVKKELPGKAVVSGKPYSAWKPMDDKDFIFSLYKNNLIYIEFNKPKSFVAEEGCTLSQTVDVKKAFLYYIKADRFAGTITVVNHDNTYKTRTGIKNTLLRFKKCVVDPLGRISFVEKEKRQRFQ

SEQ ID NO: 996 - protein, 1087 aa, Unknown
  Description of Unknown: uncultivated organism with predicted taxonomy: Dialister
  MG15-69 effector
MNYVLGLDVGITSCGWAVLELNHEDEPVRIVDLNSRIFDKAEAPKTGESLAAPRRMARGIRRLTRRRKFRLHRVRGFLVRHHILTKEEIENLYTTPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYISIFSAQRNFDEGPGANSPYAGDQIEKMIGDCTFEDGKNGRPPQKRAPKASYAFMAFNLWQKINHIRVNCKGIERSLETEEKNKIVGLAWTKENITYHDLRQITGLDEETRFSGVTYPLDSTTEEAEKKVKFSWVKPYHAMRRALDKVEKNYIQKLSREEIDAIAYAFTVYKNDRKIRTALTEKGIEDNVADVLITHLDGFSKFGHLSKYACYKLLPFLKKGEEYYKACESAGYDFRKSSMEKLEDIPNPVVKRAVTQTMKVIKAVQRKYGNPVEVHIELARELARSFKDRAAMDDRMKENHAKNEEIKEYLSKELHVMSPTGQDIVKWKLYKQQQGYCAYSQKLFDVDKLLHDRTYAEVDHILPYSRSFDDTYRNKVLVLTKENRDKGNRTPMEYLADKPERKEKFIAWVKTTIKDSKKREHLLRVKYGRDEEAEWKQRHLQDTQYISRFLYNYLRNTLELTPGYTDRKRRIIPVNGAVTGYIRKRLGIHKIRENGDLHHAVDAVVIAATTQGMIQKVTRYSQIKENETWIDDHTKVDERTGEIFFVKKAHEKDAFPEPWPRFRQELEARVSEDPEETIRRLRLPSYENAGEIKKPFVSRMPRRKVRGAAHKETVRSGKLREDGCTILKTDLSALKLKNGEIEGYYRPESDRLLYEALKKRLEAFGGKGKEAFKEPFYKPKADGTPGPLVKKVKIIEKSSLNVPVHKGQGVAYNDTMVRIDIFGVNEKGKNAYYFVPVYVSDTVKKELPCRAVVAHKPYEEWKVMDDKDFLFSLYPNDMIHVVAKREIPFTAAKGSDLEPKIQIKDTFVYYVGANIATGNIAVISHDHSYEQGSMGIKTLSQLEKCEIDVLGNVSFVKQEKRQGFR

SEQ ID NO: 997 - protein, 1082 aa, Unknown; identical to SEQ ID NO: 938
  Description of Unknown: uncultivated organism with predicted taxonomy: Dialister
  MG15-70 effector

SEQ ID NO: 998 - protein, 1081 aa, Unknown; identical to SEQ ID NO: 973
  Description of Unknown: uncultivated organism with predicted taxonomy: Dialister
  MG15-71 effector

SEQ ID NO: 999 - protein, 1082 aa, Unknown; identical to SEQ ID NO: 950
  Description of Unknown: uncultivated organism with predicted taxonomy: Dialister
  MG15-72 effector

SEQ ID NO: 1000 - protein, 1081 aa, Unknown; identical to SEQ ID NO: 951
  Description of Unknown: uncultivated organism with predicted taxonomy: Dialister invisus
  MG15-73 effector

SEQ ID NO: 1001 - protein, 1081 aa, Unknown; identical to SEQ ID NO: 951
  Description of Unknown: uncultivated organism with predicted taxonomy: Dialister
  MG15-74 effector

SEQ ID NO: 1002 - protein, 1081 aa, Unknown; identical to SEQ ID NO: 951
  Description of Unknown: uncultivated organism with predicted taxonomy: Dialister invisus
  MG15-75 effector

SEQ ID NO: 1003 - protein, 1082 aa, Unknown; identical to SEQ ID NO: 953
  Description of Unknown: uncultivated organism with predicted taxonomy: Dialister
  MG15-76 effector

SEQ ID NO: 1004 - protein, 1081 aa, Unknown; identical to SEQ ID NO: 981
  Description of Unknown: uncultivated organism with predicted taxonomy: Dialister invisus
  MG15-77 effector

SEQ ID NO: 1005 - protein, 1081 aa, Unknown; identical to SEQ ID NO: 951
  Description of Unknown: uncultivated organism with predicted taxonomy: Dialister
  MG15-78 effector

SEQ ID NO: 1006 - protein, 1003 aa, Unknown
  Description of Unknown: uncultivated organism with predicted taxonomy: Megasphaera stantonii
  MG15-79 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFLPVYVADTVKEELPNRAVLAHKPYEAWKIMKEEDFIFSLFAIDLIFVDAGKEI

SEQ ID NO: 1007 - protein, 1081 aa, Unknown; identical to SEQ ID NO: 940
  Description of Unknown: uncultivated organism with predicted taxonomy: Megasphaera sp. AM44-1BH
  MG15-80 effector

SEQ ID NO: 1008 - protein, 1082 aa, Unknown; identical to SEQ ID NO: 947
  Description of Unknown: uncultivated organism with predicted taxonomy: Megasphaera
  MG15-81 effector

SEQ ID NO: 1009 - protein, 1081 aa, Unknown; identical to SEQ ID NO: 940
  Description of Unknown: uncultivated organism with predicted taxonomy: Megasphaera sp. AM44-1BH
  MG15-82 effector

SEQ ID NO: 1010 - protein, 1081 aa, Unknown; identical to SEQ ID NO: 995
  Description of Unknown: uncultivated organism with predicted taxonomy: Veillonellaceae bacterium DNF00626
  MG15-83 effector

SEQ ID NO: 1011 - protein, 1081 aa, Unknown; identical to SEQ ID NO: 940
  Description of Unknown: uncultivated organism with predicted taxonomy: Dialister
  MG15-84 effector

SEQ ID NO: 1012 - protein, 1081 aa, Unknown; identical to SEQ ID NO: 940
  Description of Unknown: uncultivated organism with predicted taxonomy: Dialister
  MG15-85 effector

SEQ ID NO: 1013 - protein, 1082 aa, Unknown; identical to SEQ ID NO: 954
  Description of Unknown: uncultivated organism with predicted taxonomy: Dialister
  MG15-86 effector

SEQ ID NO: 1014 - protein, 1082 aa, Unknown; identical to SEQ ID NO: 958
  Description of Unknown: uncultivated organism with predicted taxonomy: Dialister
  MG15-87 effector

SEQ ID NO: 1015 - protein, 1081 aa, Unknown
  Description of Unknown: uncultivated organism with predicted taxonomy: Megasphaera sp. AM44-1BH
  MG15-88 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADEKLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENRKKRNRIPMEYLADATERKNRFIHWVKSTIRNSRKRENLLRTDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 1016 - protein, 1082 aa, Unknown; identical to SEQ ID NO: 944
  Description of Unknown: uncultivated organism with predicted taxonomy: Dialister
  MG15-89 effector

SEQ ID NO: 1017 - protein, 1081 aa, Unknown; identical to SEQ ID NO: 941
  Description of Unknown: uncultivated organism with predicted taxonomy: Dialister
  MG15-90 effector

SEQ ID NO: 1018 - protein, 1094 aa, Unknown; identical to SEQ ID NO: 985
  Description of Unknown: uncultivated organism with predicted taxonomy: Dialister
  MG15-91 effector

SEQ ID NO: 1019 - protein, 840 aa, Unknown; identical to SEQ ID NO: 943
  Description of Unknown: uncultivated organism with predicted taxonomy: Firmicutes
  MG15-92 effector

SEQ ID NO: 1020 - protein, 1103 aa, Unknown
  Description of Unknown: uncultivated organism with predicted taxonomy: Megasphaera micronuciformis
  MG15-93 effector
MDPKELKYVVGLDIGITSVGWATLLLDSQDEPVRILDLNSRIFDKAEVPKTGASLAAPRRMARGVRRRLRRRKFRLHRVRQYILRHHILAKAGLDCLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRFEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYMILPYLEQGLVYSDACTAAGYDFRKSAQGSIADIPNPVVKRAISQTMKVLKAIKQKYGCPPVEVHIEMARELAKSFDERQKMTKSIEENQSHNERIKERLQKEFNVPYPSGQDIVKLKLYEEQNETCAYSQKHIDAAKLFHDRNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVLDKINLAVQVHGGNGATSNANGSMIRVDIFKVQEKNGKHSYYSVPIYVADTVKAELPKKAVYRRPYDEWPEMKEADFAFSLYPNDAIYIGGKEIKMNAMPGCTLETTRSMQDVNLYFRGMDISTGAIRVVNHDGTYEQRSLGIKQLPIIEKYEVSVLGDLVKAMYSPRETFKHKAQRAK

SEQ ID NO: 1021 - protein, 1081 aa, Unknown; identical to SEQ ID NO: 979
  Description of Unknown: uncultivated organism with predicted taxonomy: Dialister
  MG15-94 effector

SEQ ID NO: 1022 - protein, 1081 aa, Unknown; identical to SEQ ID NO: 952
  Description of Unknown: uncultivated organism with predicted taxonomy: Dialister
  MG15-95 effector

SEQ ID NO: 1023 - protein, 1103 aa, Unknown
  Description of Unknown: uncultivated organism with predicted taxonomy: Megasphaera micronuciformis
  MG15-96 effector
MDPKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSTAVAGGEDGVMLKAIQQNKEVLSKYRSVGEMFDKDEKFSDHKRNKGGSYEFTVARSMLEDEIKLLFEKQRDFGSAFAEKDAEEEYIDLFSAQRNFDEGPGGDSPYGGNQIEKMIGLCTFEGKNGEKRAPKASYAFMATNLWQKINQIRIIEKGTERPLIAEEAGKIYEKAWNKEAMTYKDIRSEISLGDEASFKGLPYKWTETDKEETEGKAKFSWVKEYHTLRKVLDKVEKNRILQLSHDNIDNIAYIFSVYKNDDKIREALEETDLDSKDIDVLIEKLGTFSKFGHLSLKACYKILPYLEQGMVYSDACTAAGYDFKKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNEICAYSQKHIDAAKLFHDPNYAEVDHIIPYSRSFDDTYNNKVLVLTAENRQKGNRTPMEYLSGDEARKKQFVAWVKSDIKKPRKRENLLREKFTTDAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSPGPIVKKCKVIDKINLAVQVHGGKGATANANGSMIRVDIFKVQEKNGKSYYYAVPIYVADTVKSELPKKAVYRRPYDEWPEMKEADFAFSLYPNDVVYIGGKEIKMNVMPGCTLESEKSMRDEVLYFKGLDIATGTIRVVNHDGTYKQKSLGIKQLSIIEKYEVSVLGDLVKAMYSPRETFKHKAQRAK

SEQ ID NO: 1024 - protein, 1104 aa, Unknown; identical to SEQ ID NO: 946
  Description of Unknown: uncultivated organism with predicted taxonomy: Megasphaera micronuciformis
  MG15-97 effector

SEQ ID NO: 1025 - protein, 1082 aa, Unknown; identical to SEQ ID NO: 953
  Description of Unknown: uncultivated organism with predicted taxonomy: Dialister
  MG15-98 effector

SEQ ID NO: 1026 - protein, 1104 aa, Unknown
  Description of Unknown: uncultivated organism with predicted taxonomy: Megasphaera micronuciformis
  MG15-99 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRQLKPEEWARILLYMAKHRGFKSNRKSAAVAGGDDGVMLKAIQQNKEVLSKYRSVGEMFDKDEKFSDHKRNKDGSYEFTVARSMLEDEIKLLFEKQRDFGSVFAKKDAEEEYIDLFSAQRNFDEGPGGDSPYGGNQIEKMIGLCTFEGKNGEKRAPKASYAFMATNLWQKINQIRIIEKGTERPLTAEEAGKIYEKAWNKEAMTYKDIRSEISLGDEASFKGLPYKWTETDKEETEGKAKFSWVKEYHTLRKVLDKVEKNRILQLSHDNIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVLDKINLAVPVHDGKGITKNAGGSMVRVDVFKVKKSNGGHQYYLVPIYVSDTVKERLPNRAVMAHKEYDEWKIVDDKDFVFSLYSNDLLFIGGKEIKLNGTGGDTLHQGIMVQNVYLYYRGLNIAAGTISVEDHDSKYIQESLGVGRVPVLEKYEVSVLGDLIKAPYRPRETFKHKAQRSK

SEQ ID NO: 1027 - protein, 1103 aa, Unknown; identical to SEQ ID NO: 945
  Description of Unknown: uncultivated organism with predicted taxonomy: Megasphaera stantonii
  MG15-100 effector

SEQ ID NO: 1028 - protein, 1081 aa, Unknown; identical to SEQ ID NO: 952
  Description of Unknown: uncultivated organism with predicted taxonomy: Dialister
  MG15-101 effector

SEQ ID NO: 1029 - protein, 1082 aa, Unknown; identical to SEQ ID NO: 953
  Description of Unknown: uncultivated organism with predicted taxonomy: Megasphaera
  MG15-102 effector

SEQ ID NO: 1030 - protein, 1089 aa, Unknown; identical to SEQ ID NO: 968
  Description of Unknown: uncultivated organism with predicted taxonomy: Megasphaera sp. AM44-1BH
  MG15-103 effector

SEQ ID NO: 1031 - protein, 1082 aa, Unknown
  Description of Unknown: uncultivated organism with predicted taxonomy: Dialister
  MG15-104 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEINTLFEIQRNLGQKFADEKLEEEYVILFASQRKFDEGPGENSPYAGNQIEKMIGSCTLEGKKEKRAPKASYVFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIERYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKESIRSGRLKEEGYTISKTALIDLKLTGDKEEIKGYYNKESDRLLYEALKKQLQRYGGKAKEAFKEPFHKPKADGTPGPIVNKVKIMEKSTMLIPVNDGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKVSRFLMYYKGADIATGSISGVNHDETYKARGVGIQSLREIKKCCIDVLGNISFASKEKRQTFR

SEQ ID NO: 1032 - protein, 1075 aa, Unknown
  Description of Unknown: uncultivated organism with predicted taxonomy: Megasphaera micronuciformis
  MG15-105 effector
MDTKEMKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSAAVAGGDDGDMLDAIRKNKEVLSKYRSVGEMFDKDEKFSDHKRNKGGSYEFTVARSMLVDEIKLLFERQRDFGSAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEAYFKGLSYKWTETDKEETESKVKFSLVKEYHTLRKVLDKVEKNRILQLSHDDIDNIAYIFSVYKNDDKIREALEETDLDSKDIDVLIEHLGTFRKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSPGPIVKKCKVIDKISLAVPVHGGKGATANANGSMIRVDIFRVKEKNNKHSYYAVPIYVADTVKDKLPNKAIVAKKNYDEWLEMKKEDFVFSLYPNSAVYIGGKDIKMNVMSGCTLELEKTMRDTILYYKGLDISPGALKIINHDGTYQQRGLGIKSLPFIE

SEQ ID NO: 1033 - protein, 1082 aa, Unknown; identical to SEQ ID NO: 949
  Description of Unknown: uncultivated organism with predicted taxonomy: Dialister
  MG15-106 effector

SEQ ID NO: 1034 - protein, 1082 aa, Unknown; identical to SEQ ID NO: 953
  Description of Unknown: uncultivated organism with predicted taxonomy: Dialister
  MG15-107 effector

SEQ ID NO: 1035 - protein, 1082 aa, Unknown; identical to SEQ ID NO: 977
  Description of Unknown: uncultivated organism with predicted taxonomy: Dialister
  MG15-108 effector

SEQ ID NO: 1036 - protein, 1109 aa, Unknown
  Description of Unknown: uncultivated organism with predicted taxonomy: Megasphaera stantonii
  MG15-109 effector
MDPKELKYVVGLDIGITSVGWATLLLDSQDEPVRILDLNSRIFDKAEVPKTGASLAAPRRMARGVRRRLRRRKFRLHRVRQYILRHHILDKAGLECLYKPKMDIDIFALRTAGLDRLLEPEEWARILLYMAKHRGFKSNRKSTAVAGGDDGIMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTHLDSKDIDVLIENLGTFSKFGHLSLKACYNILPYLEQGMVYSDACTAAGYDFRKSAQGSIADIPNPVVKRAISQTMKVLKAIKQKYGCPPVEIHIEMARELAKSFDERQKMAKSIEENQSHNERIKERLQKEFNVPYPSGQDIVKLKLYEEQNETCAYSQKHMDAHRLFHEDNYAEVDHIIPYSRSFDDTYNNKVLVLTAENRQKGNRTPMEYLSGDEARKKQFVAWVKSDIKKPRKRENLLREKFTTDAENDWKIRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVTKCKVLDKINLAVQVHGGKGITKNAGGSMVRVDVFKVKKSNGGHQYYLVPIYVADTVKERLPNRAVMAHKEYDEWKIVDDKDFVFSLYPNDLLFIGGKEIKLNGTGGDTLHQGIMVQNVYLYYRGLNIAVGTISVEDHDSKYIQESLGVGRVPVLEKYEVSVLGDLIKAQYRPRETFKHKAQRTKDQVNV

SEQ ID NO: 1037 - protein, 1081 aa, Unknown; identical to SEQ ID NO: 990
  Description of Unknown: uncultivated organism with predicted taxonomy: Dialister
  MG15-110 effector

SEQ ID NO: 1038 - protein, 1082 aa, Unknown; identical to SEQ ID NO: 953
  Description of Unknown: uncultivated organism with predicted taxonomy: Veillonellales
  MG15-111 effector

SEQ ID NO: 1039 - protein, 1081 aa, Unknown; identical to SEQ ID NO: 952
  Description of Unknown: uncultivated organism with predicted taxonomy: Dialister
  MG15-112 effector

SEQ ID NO: 1040 - protein, 1082 aa, Unknown; identical to SEQ ID NO: 953
  Description of Unknown: uncultivated organism with predicted taxonomy: Dialister
  MG15-113 effector

SEQ ID NO: 1041 - protein, 1087 aa, Unknown
  Description of Unknown: uncultivated organism with predicted taxonomy: Veillonellales
  MG15-114 effector
MNYVLGLDVGITSCGWAVLELNHEDEPVRIVDLNSRIFDKAEAPKTGESLAAPRRMARGIRRLTRRRKFRLHRVRGFLVRHHILTKEEIENLYITPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYISIFSAQRNFDEGPGANSPYAGDQIEKMIGDCTFEDGKNGRPPQKRAPKASYAFMAFNLWQKINHIRVNSKGIERSLETEEKNKIAGLAWTKENITYHDLRQIAGLDEETRFSGVTYPLDSTTEEAEKKVKFSWVKPYHAMRRALDKVEKNYIQKLSREEIDAIAYAFTVYKNDKKIRTALAEKGIEDNVADVLITHLDGFSKFGHLSEYACYKLLLFLEKGEEYYKACESAGYDFRKSSMEKLEDIPNPVVKRAVTQTMKVIKAVQRKYGNPVEVHIELARELARSFKDRAAMDDRMKENHAKNEEIKEYLSKELHVMSPTGQDIVKWKLYKQQQGYCAYSQKPFDVNKLLHDRTYAEVDHILPYSRSFDDTYRNKVLVLTKENRDKGNRTPMEYLADKPERKGKFIAWVKTTIKDSKKREHLLRVKYGRDEEAEWKQRHLQDTQYISRFLYNYLKNTLELTPGYTDRKRRIIPVNGAVTGYIRKRLGIHKIRENGDLHHAVDAVVIAATTQGMIQKVTRYSQIKENETWIDDHTKVDERTGEIFFVKKAHEKDAFPEPWPRFRQELEARVSEDPEEAIRRLGLPSYENVGEIKKPFVSRMPRRKVRGAAHKETVRSGKLRKDGYTILKTDLSALKLKNGEIEGYYRPESDRLLYEALKKRLEAFGGKGKEAFKEPFYKPKADGTPGPLVKKVKIIEKSSLNVPVHKGKGVAYNDTMVRIDIFGVNEKGKTAYYFVPVYVSDTVKKELPCRAVVAHKPYEEWKVMDDKDFLFFLYPNDMIHVVAKRDLSFTAAEGADLAPTMETKDTCVYYKAADISAGNIKVITHDNSYEKRGFGIKTLLQLEKCEVDVLGNISVVKKEKRQGFC

SEQ ID NO: 1042 - protein, 1082 aa, Unknown; identical to SEQ ID NO: 953
  Description of Unknown: uncultivated organism with predicted taxonomy: Dialister
  MG15-115 effector

SEQ ID NO: 1043 - protein, 1081 aa, Unknown; identical to SEQ ID NO: 940
  Description of Unknown: uncultivated organism with predicted taxonomy: Megasphaera sp. AM44-1BH
  MG15-116 effector

SEQ ID NO: 1044 - protein, 1084 aa, Unknown; identical to SEQ ID NO: 962
  Description of Unknown: uncultivated organism with predicted taxonomy: Megasphaera
  MG15-117 effector

SEQ ID NO: 1045 - protein, 1081 aa, Unknown; identical to SEQ ID NO: 981
  Description of Unknown: uncultivated organism with predicted taxonomy: Dialister
  MG15-118 effector

SEQ ID NO: 1046 - protein, 1078 aa, Unknown; identical to SEQ ID NO: 974
  Description of Unknown: uncultivated organism with predicted taxonomy: Dialister
  MG15-119 effector

SEQ ID NO: 1047 - protein, 1104 aa, Unknown
  Description of Unknown: uncultivated organism with predicted taxonomy: Megasphaera micronuciformis
  MG15-120 effector
MDPKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLVFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGMVYSDACTAAGYDFRESAKGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLNGDEARKKQFVAWVKSDIKKPRKRENLLREKFTDDVENDWKERHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGSIVKKCKVLDKINLAVQVHGGKGITKNTGGSMVRVDVFKVKKGNGGHQYYLVPIYVADTVKEKLPNRAVVGSTSYDGWKILHDDSFVFSLYPNELVHISGKKIKLKGTGGNTKGQEINIEDAYLYYKALNISNGMITVVTHDNTYIQESLGIGRVPTLEKYEVSVLGDLVKATYRPRETFKHKAQRFK

SEQ ID NO: 1048 - protein, 1104 aa, Unknown; identical to SEQ ID NO: 942
  Description of Unknown: uncultivated organism with predicted taxonomy: Megasphaera micronuciformis
  MG15-121 effector

SEQ ID NO: 1049 - protein, 1081 aa, Unknown; identical to SEQ ID NO: 952
  Description of Unknown: uncultivated organism with predicted taxonomy: Dialister invisus
  MG15-122 effector

SEQ ID NO: 1050 - protein, 1082 aa, Unknown; identical to SEQ ID NO: 970
  Description of Unknown: uncultivated organism with predicted taxonomy: Megasphaera
  MG15-123 effector

SEQ ID NO: 1051 - protein, 1081 aa, Unknown
  Description of Unknown: uncultivated organism with predicted taxonomy: Dialister
  MG15-124 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADEKLEEEYVILFVAQRKFDEGPGENSPYAGNQIEKMIGSCTLEGKKEKRAPKASYAFMAFNLWQKINHLKINRRGSERFLTEEERRRIADLEWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFRLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMPVPVNGGKGLASNGNMVRIDVFRSEEKGKKKYYFIPIYVADTVKEELPNRAALAHKPYEAWKIMKEEDFIFSLYPNDLIFVDAGKEIPFKAALKGSTLDPEKKASRFLMYYKGADIAGGTINGVNHDNTYGIRIGLQQLKGIRKCRIDVLGNISFASKEKRQTFR

SEQ ID NO: 1052 - protein, 1081 aa, Unknown; identical to SEQ ID NO: 960
  Description of Unknown: uncultivated organism with predicted taxonomy: Dialister
  MG15-125 effector

SEQ ID NO: 1053 - protein, 1103 aa, Unknown
  Description of Unknown: uncultivated organism with predicted taxonomy: Megasphaera stantonii
  MG15-126 effector
MDTKELKYVVGLDIGIASVGWATLLLDSQDEPVRILDLNSRIFDKAEVPKTGASLAAPRRMARGVRRRLRRRKFRLHRVRQYILRHHILDKVGLECLYKPKTDIDIFALRTAGLDRLLEPEEWARILLYMAKHRGFKSNRKSAAVAGGDDGVMLDAIRKNKEVLSKYRSVGEMFDKDEKFSAHKRNKGGSYEFTVARSMLEDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKGAMTYKDIRSEISLGDEAYFKGLSYKWTETDKEETESKVKFSLVKEYHTLRKVLDKVEKNRILQLSHDDIDNIAYIFSVYKNDDKIREALEETDLDSKDIDVLIEHLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKQRKRENLLREKFTADAENDWKARHLQDTQYISRFMLNYLQNNYELTPGNTDRKRRIIPVNGAVTAYVRKRLGISKIRENGDLHHAVDATVIAAVTQGVVNSVSKYSKRHELQYHVDEHGNCVDLVTGKLMGDAFKENHKIKGFPEPWPQFRAELEARVSENAAEAIRTLNLPTYSSDEEIKTPFVSRMVRHKTTGQAHEDTVRGKSNVADNEYVKKVALTELKLKDGEIEGYYNRPSDRLLYEALKKRLEQFGGKGKDAFKEPFYKPKSDGSPGPIVKKCKILDKINLAVQVHGGKGATANANGSMIRVDIFKAKEKNGKYSYYAVPIYVADTVKEELPNKAVCNKEYNRWPKMKEEDFAFSLYPNDVVYIGGKEIKMNAAPGCTLETTRSIQDVNLYFRGMDISTGAIRVVNHDGTYKQKSLGIKQLPLIEKYEVSVLGDLVKAIYKPRETFKHKVRRSK

SEQ ID NO: 1054 - protein, 1081 aa, Unknown; identical to SEQ ID NO: 973
  Description of Unknown: uncultivated organism with predicted taxonomy: Dialister
  MG15-127 effector

SEQ ID NO: 1055 - protein, 1081 aa, Unknown; identical to SEQ ID NO: 991
  Description of Unknown: uncultivated organism with predicted taxonomy: Dialister invisus
  MG15-128 effector

SEQ ID NO: 1056 - protein, 1081 aa, Unknown; identical to SEQ ID NO: 991
  Description of Unknown: uncultivated organism with predicted taxonomy: Dialister
  MG15-129 effector

SEQ ID NO: 1057 - protein, 1081 aa, Unknown; identical to SEQ ID NO: 940
  Description of Unknown: uncultivated organism with predicted taxonomy: Dialister
  MG15-130 effector

SEQ ID NO: 1058 - protein, 1081 aa, Unknown; identical to SEQ ID NO: 976
  Description of Unknown: uncultivated organism with predicted taxonomy: Dialister
  MG15-131 effector

SEQ ID NO: 1059 - protein, 1092 aa, Unknown
  Description of Unknown: uncultivated organism with predicted taxonomy: Veillonella magna
  MG15-132 effector
MNYVLGLDVGITSVGWAVLELNSQDDPIRIVDLNSRIFEKAENPKNGESLALPRRQARSIRRLTRRRRFRLQRVRRYIVRSGILNKETLHRLYNTMEGLPDIYELRYRGLTQPLSAEEWSRLLIFFAKHRGFKSNRKNASDGDDGEMLSAVKANQELLKSYRTVGEMLYKNEKFKECKHNKGGSYAFTVSRAMLEDEIRALFEVQRQLGQAYAAEELEKEYIEIFGAQRNFDEGPGAGSPYGGDQIEKMIGTCTFEPMEKRAPKVSYGFMAFNLWQKINHLGLIANGVARSFTAEEKQQIADLAWSKNNLHLQHIRKELRIPEDTIFSGVNYGIRKQDTEWAKQLEEVEKKQKFNWLTPYHEMRVALDAVKKHRITELSPDQIDTIAYAFTVFKNDEKITSYLRENGIEEDDIRALLSKVKGFSKFGHLSLKACYKILPYLEEGNIYSKACELAGYDFRSSSQEQLEDIPNPVVKRAISQTLKVIKAIVRRYGNPVEVHIELARELARNFEDRRTMQKSMEDNQKRNEEIKERLVKEYNVLQPTGMDIVKFKLYEEQQGACAYSQKMFDVNRVLHDPSYSEVDHIIPYSRSFDDSYNNKVLVLTKENRDKGNRTPMEYLKDNPVRIDAFTTWVNAIVRNSRKRANLLKSSFTEDAEQEWKRRHLQDTQYISRFLYNYLRQNLPLKEGFTNRKRRIIPVNGAVTSYVRKRLGIAKIRENGDLHHAVDAVIIACVTQGVIKRVSEYSKSRELWLYQLDDGTVIDGETGEVMTGQRGHKQEPFPEPWPEFRHELEDRVSENPPELLRHLQLPAYEGIDIETIKTPFVSRMPNRKVKGQAHEETIRSGRLKYEGYTVTKVDLKNLKLKNGEIEGYYNPDSDRLLYNALKQQLEVYDGKGDKAFAEPFHKPKADGTPGPIVKKVKIMTKSNLNVPVNGGKGVADNGSMVRIDVFGVEERGKMAYRFIPIYVSDTVKRILPNKAVTRDRGYKDWDIMDDKDFLFSLYPNDLIYVESKRDISLKAAKGSTLAKERKQKEALVYYRGADIATASIGVVNDDNTYSMRGLGIKTLQSIRKCIVDVLGNVAFVTKEKRQGFR

SEQ ID NO: 1060 - protein, 1082 aa, Unknown; identical to SEQ ID NO: 953
  Description of Unknown: uncultivated organism with predicted taxonomy: Dialister
  MG15-133 effector

SEQ ID NO: 1061 - protein, 1103 aa, Unknown; identical to SEQ ID NO: 993
  Description of Unknown: uncultivated organism with predicted taxonomy: Megasphaera micronuciformis
  MG15-134 effector

SEQ ID NO: 1062 - protein, 1103 aa, Unknown; identical to SEQ ID NO: 945
  Description of Unknown: uncultivated organism with predicted taxonomy: Megasphaera micronuciformis
  MG15-135 effector

SEQ ID NO: 1063 - protein, 796 aa, Unknown
  Description of Unknown: uncultivated organism with predicted taxonomy: Megasphaera stantonii
  MG15-136 effector
VAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRITPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFV

SEQ ID NO: 1064 - protein, 1089 aa, Unknown; identical to SEQ ID NO: 968
  Description of Unknown: uncultivated organism with predicted taxonomy: Megasphaera sp. AM44-1BH
  MG15-137 effector

SEQ ID NO: 1065 - protein, 1086 aa, Unknown
  Description of Unknown: uncultivated organism with predicted taxonomy: Megasphaera
  MG15-138 effector
MNYVLGLDIGITSVGWAVLELDTHDEPIRIVDLNSRIFEKAEVPKTGEALAAPRRMARSARRLTRRRRFRLHRVRRYLIRNDILDEQQVAVLYDDSAGKTDIYELRYQALSQPVSNSDWARLLIFFAKHRGFKSNRKHISDSGDEGQMLNAITENQELLKNYRTVGEMLYKNEKFKACKRNKGGSYTFTVSRAMLTDEIHTLFDVQRNLGQAYASEKLKEEYMELFSAQRNFDEGPGMNSPYSGNQIEKMIGCCTFEDGEKRAPKASYAFMAFNIWQKINHLRVTCEGTYRFLSQAEKETLAAFAWKKENITFKDIRNKLGLDDTVRFLDVNYNLDQYKTAEEAEKKAKFSWVKEYHAIRKALDKVKKDRISELSHEQIDAIAYAFTVYKNDEAIKSYLLEHAIELADAEALLENISGFSKFGHLSVKACYKLLEPLKQGHVYTKACEIAGYDPQKSSQGNISDIPNPVVKRALSQALKVIKAIIRQYGCPPVEIHIELARELAKNAKERTELEKAMKDNQSRNEEIKTKLHELNVMQPTGLDIVKYKLYEQQQGDCAYSQKKFDVDRLLHDSTYAEVDHIIPYSRSFDDTYRNKVLVLTKENRDKGNRTPMEYFQDKPERKEAFVRWVKRTISDGKKRNNLLRVNYSADAEKEWKDRHLQDTQYISRYLYNYLRQHIPLKEGYTDRKRRIIPVNGAVTAYVRKRLGISKIRENGDLHHAVDAVIIACVTQGVVNKISCYSKIKELRQFMTADGTIVDKETGEVLQTANPRKTDPFPEPWPKFRQELEARVSDNPAEAIAALGLPTYEGIVSISAPFVSRMPNRKVHGPAHMETIRSAKMQQDGYTMVKTDLTNLKLKDGEIEGYYNPSSDKILYDALKRRLEQFGGDSNKAFKDPFYKPKSDGTPGPEVKKVKIMTKSSLNVTVNQGKGIADNGSMIRIDVFGVEERGKNAYYFVPIYVADTVKETLPNKAVVPNKSYNDWKVMRDEDFLFSLYPNDLIYIESPTPISFHTVKGCPLVPKIERKEMFLYYRKAGISTASITVLNHDNTYVKESLGIKTIAKLQKCTVDVLGNIHYVQKEKRLGFK

SEQ ID NO: 1066 - protein, 1086 aa, Unknown
  Description of Unknown: uncultivated organism with predicted taxonomy: Megasphaera
  MG15-139 effector
MNYVLGLDIGITSVGWAVLELDTHDEPIRIVDLNSRIFEKAEVPKTGESLAAPRRMARSARRLTRRRRFRLHRVRRYLIRNRILDARQVEELYVDSIGKTDIYELRYQALSQQVSNSDWARLLIFFAKHRGFKSNRKHISDSGDEGQMLNAITENQEILNNYRTVGEMLYKNEKFKACKRNKGGSYAFTVSRDMLADEIHALFDVQRSLGQAYASEKLEEEYMELFSAQRNFDEGPGMNSPYSGNQIEKMIGCCTFEDGEKRAPKASYAFMAFNVWQKINHLRVTCEGTYRSLSQAEKETLAALAWKKENITFKDIRNKLGLDDTVRFLDVNYNLDKYKTAEEAEKKVKFSWVKEYHAIRKALDKVKKDRISELSHEQIDTIAYAFTVYKNDEAIKRYLLEHAIEPADAEALLENISGFSKFGHLSVKACYRLLEPLQQGHVYTKACEIAGYDPQKSNQENINDIPNPVVKRALSQALKVIKAIIRQYGCPPVEIHIELARELAKSAKERTELEKAMKDNQSRNEEIKTKLHELNVMQPTGLDIVKYKLYEQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYISRYLYNYLKRHIELKEGYTDRKRRIIPVNGAVTAYVRKRLGISKIRENGDLHHAVDAVIIACVTQGVVNKISRYSKIKELRQFMTADGMIVDKETGEVLQTANPRKTDPFPEPWPKFRQELEARVSDNPAEAIAALGLPTYEGIVNISAPFVSRMPNRKVHGPAHMETIRSSKMQQDGYTMVKTELTNLKLKDGEIEGYYNPSSDKILYDALKRRLEQFGGDGNKAFKDPFYKPKSDGTPGPEVKKIKIMTKSSLNVTVNQGKGVADNGSMVRIDVFGVEEKGKNAYYFVPIYVADTVKETLPNRAVTRGEPYNNWKIMKDEDFLFSLYPNDLIYIESLSPVSFHTVKGCTLVSKIERKEMLLYYRKAGISTASITVLNHDNTYVKESLGIKTIGKLQKCTVDILGNVHYVQKEKRVGFK

SEQ ID NO: 1067 - protein, 1089 aa, Unknown
  Description of Unknown: uncultivated organism with predicted taxonomy: Megasphaera sp. AM44-1BH
  MG15-140 effector
MHYVLGLDIGITSVGWAVLELNIQDEPIRIVDLNSRIFERAEIPKTGESLAAPRRVARSSRRRTRRRRFRLYRIRRYLLRNQIITPSDMKILYDNCGDMKDIYTLRHEALDRAVTSKEWARLLIFFGKHRGFKSNRKSIIASGDEGVMLQAVKENQELLKAYRTVGDMLYSDTKFANAKRNKGESYTFTVSRRMLTDEIRTLFCIQRDLGQSFATPSLEDEYLSIFLAQRNFDEGPGGNSPYSGNQIEKMIGNCAFEKNEKRAPKASYAFMAFNLLQKINHLRIERKGKQRFLTQEERNNIAGLAWKKENLTFKDIRTAISLSGDELFQDVHYASEVSLEECEKKTKFNLVRSYHAMRKALDAVEKNRIQKLSHEQLDTIAYAFTVYKNDDKISSYLLAHSIEQQDVEALLAQLRTFNKFGHLSIKACYRILPYLKEGKTYAAACTSAGYDFRNSSLEEIKDIPNPVVKRAVSQTLKVIRAIIKKYGCEPVEIHIELARELARSFQNRVKMQKSMEENQSRNEKIKERLVQEYNILSPTGMDIVKFKLYEQQQGACAYSQKMFNIYQLFHDPSYAEVDHIIPYSRSFDDSYRNKVLVFTAENRNKGNRTPMEYLKNQSERKEQFITWVKNTIRDYKKRNNLLRETYTSEDEADWKRRHLQDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEMLTLKHVHKKDPFPEPWPHFRQELEARVGKQPQEAIAALHLPTYENVESIYTPFVSRMPNRKVHGPAHLETIRSSKLLYKGITIVKTSLTNLKLKDGEIQGYYNPDSDRILYQALKRRLIQFDGEGRAAFKEPFYKPRSDGSPGPMVKKVKIMTNSSLNVLLNHGRGVADNGAMVRIDVFYVSEKGKKAYYFVPIYVADTVKKELPHKAVVAYKPCEEWKNVDDDDFIFSLYPNDLVYVRHKKSILLKASKRSTLSPQIKIKEGLFYYKGANISVGSISIINNDDTYGQHSLGIKTLECMKKANVDILGNVTFVGRENRQPFQLSKK

SEQ ID NO: 1068 - protein, 1081 aa, Unknown
  Description of Unknown: uncultivated organism with predicted taxonomy: Dialister
  MG15-141 effector
MNYVLGLDVGIASVGWAVLELNEEDNPIRIEGLGARIFEKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEENLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIISVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLRRLKGIRKCRIDVLGNISLVGKEKRKTFR

SEQ ID NO: 1069 - protein, 1089 aa, Unknown
  Description of Unknown: uncultivated organism with predicted taxonomy: Megasphaera sp. AM44-1BH
  MG15-142 effector
MHYVLGLDIGITSVGWAVLELNIQDEPIRIVDLNSRIFERAEIPKTGESLAAPRRVARSSRRRTRRRRFRLYRIRRYLLRNQIITPSDMKILYDNCGDMKDIYTLRHEALDRAVTSKEWARLLIFFGKHRGFKSNRKSIIASGDEGAMLQAVKENQELLKAYRTVGDMLYSDTKFANAKRNKGESYTFTVSRRMLTDEIRTLFCIQRDLGQSFATPSLEDEYLSIFLAQRNFDEGPGGNSPYSGNQIEKMIGNCAFEKNEKRAPKASYAFMAFNLLQKINHLRIERKGKQRFLTQEERNNIAGLAWKKENLTFKDIRTAISLSGDELFQDVHYASEVSLEECEKKTKFNLVRSYHAMRKALDAVEKNRIQKLSHEQLDTIAYAFTVYKNDDKISSYLLAHSIEQQDVEALLAQLRTFNKFGHLSIKACYRILPYLKEGKTYAAACTSAGYDFRNSSLEEIKDIPNPVVKRAVSQTLKVIRAIIKKYGCEPVEIHIELARELARSFQNRVKMQKSMEENQSRNEKIKERLVQEYNILSPTGMDIVKFKLYEQQQGACAYSQKMFNIYQLFHDPSYAEVDHIIPYSRSFDDSYRNKVLVFTAENRNKGNRTPMEYLKNQSERKEQFITWVKNTIRDYKKRNNLLRETYTSEDEADWKRRHLQDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEILTLKHVHKKDLFPEPWPHFRQELVARVGKQPQEAIAALHLPTYENVESIYTPFVSRMPNRKVHGPAHLETIRSSKLLYKGITIVKTSLTNLKLKDGEIQGYYNPDSDRILYQALKRRLIQFDGEGRAAFKEPFYKPRSDGSPGPMVKKVKIMTNSSLNVLLNHGRGVADNGAMVRIDVFYVSEKGKKAYYFVPIYVADTVKKELPHKAVVAYKPCEEWKNVDDDDFIFSLYPNDLVYVRHKKSILLKASKRSTLSPQIKIKEGLFYYKGANISVGSISIINNDDTYGQHSLGIKTLECMKKANVDILGHVTFVGRENRQSFQLSKK

SEQ ID NO: 1070 - protein, 1103 aa, Unknown
  Description of Unknown: uncultivated organism with predicted taxonomy: Megasphaera micronuciformis
  MG15-143 effector
MDTKELKYVVGLDIGITSVGWATLLLDSQDEPVRILDLNSRIFDKAEVPKTGASLAAPRRMARGVRRRLRRRKFRLHRVRQYILRHHILDKVGLECLYKPKTDIDIFALRTAGLDRQLKPEEWARILLYMAKHRGFKSNRKSTADETADGDMLKAIQQNKEILSKYRSVGEMFDKDEKFSDHKRNKGGSYEFTVARSMLEDEIKLLFEKQRDFGSAFAEKDAEEEYIDLFSAQRNFDEGPGGDSPYGGNQIGKMIGLCTFEGKNGEKRAPKASYAFMATNLWQKINQIRIIKKGTELHLTAEEAGKIYEKAWNKEAMTYKDIRSEISLGDEASFKGLAYKWTETDKEETESKTKFSWVKEYHTLRKVLDKVEKNRILQLSHDEIDNIAYVFSVYKNDDKIREALEETDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHMDAHRLFHENNYAEVDHIIPYSRSFDDTYNNKVLVLTAENRQKGNRTPMEYLSGDEARKKQFVAWVKSDVKKPRKRENLLREKFTDDAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENATEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSSGPIVKKCKVLDKINLSVPVHGGKGAAANANGGMIRVDIFKAKGKNGKSSYYAVPIYVADTVKVELPNRAVVTKKTYAEWPEMKTEDFAFSLYPNDVVYIGGKEIKMNVMPGCTLATENHVKDDFFYYKGLDIATGAMIVINHDGTYKQRGVGIKQLPLIEKYEVSVLGDLVKAIYRPREIFKHKAQRSK

SEQ ID NO: 1071 - protein, 831 aa, Unknown
  Description of Unknown: uncultivated organism with predicted taxonomy: Megasphaera stantonii
  MG15-144 effector
LAKAGLDCLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGLVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDRNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIV

SEQ ID NO: 1072 - protein, 1056 aa, Unknown
  Description of Unknown: uncultivated organism with predicted taxonomy: Megasphaera stantonii
  MG15-145 effector
EVPKTGASLAAPRRMARGVRRRLRRRKFRLHRVRQYILRHHILDKAGLECLYKPKTDIDIFALRTAGLDRLLEPEEWARILLYMAKHRGFKSNRKSASDASDDGDMLDAIRKNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKVKFSLVKEYHTLRKVLDKVEKNRILQLSHDDIDNIAYIFSVYKNDDKIREALEETDLDSKDIDVLIEHLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWAQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSTGPIVKKCKVLDKINLAVQVHGGKGATANANGSMIRVDIFKVQEKNGKHSYYSVPIYVADTVKAELPKKAVYRRPYDEWPEMKEADFAFSFYPNDVVYIGGKEIKMNIMPGCTLATENHVKNDFFYYKGLDIATGAMIVINHDGTYKQRGVGIKQLPLIEKYEVSVLGDLVKAPYRQRETFKRKVHGSK

SEQ ID NO: 1073 - protein, 757 aa, Unknown
  Description of Unknown: uncultivated organism with predicted taxonomy: Megasphaera stantonii
  MG15-146 effector
AEGLSRRLDDGEWVRVLYHIAKHRGFKSNRKSAASDADEGKVLDAVKENAELLKNYKTVGEMLFRDEKFRDAKRNKGGSYSFCVGRDMLADEIAALFDAQRRNGNKHASEEFEKACLKIFADQRSFDDGPDINSPSPYAGNQIEKMIGNCSLEPKEKRAPKASYSFMRFSLLQKINHLRLKDAKGEERPLDDEERAAVEALAWKSASLTYGAIRKALSLSDDLRFTDLYYRWDKKPEEIEKKKLPFAAPYHEIRKALDKLEKGRIQKLTPDALDAIGYIFTVFKNDTKIAAALKTAGVEEEDAAALMDYGLTFRGFGHISVKACRKLIPHLEKGMTYDKACKEAGYDLQKTGGEKTKLLSGNLEEIREIPNPVVRRAIAQTVKVVNAVIRRYGSPVAVNVELAREMGRSFQERRDMMKSMEDNNAANEKLKEEIKKDYGIAHPNGLDIVKYKLFKEQGERCAYSLKPMDARQVLKDPSYAEVDHILPYSRSFDDSYANKVLVLAKENRDKGNRTPMEYMANLPERKHAFITWVKSNVRNPKKRDNLLLEKFDGDKEDAWKERHLNDTKYISSFVKNLLDDHLEFAPWLTGKNRHVMAVNGAVTDYTRKRLGIRKIREDGDLHHAVDAAVIAIVTQGNIQKLTNYSKQIERSRAFAKNPDGSYSDRETGEILKKDELIVRMSKHFPEPWPGFRRELEARVSDHPKELLESLRLPTYTPEELDALKPPFVSRMPTRKVRGAAHLETVVSPRLQKEGLIV

SEQ ID NO: 1074 - protein, 913 aa, Unknown
  Description of Unknown: uncultivated organism with predicted taxonomy: Selenomonas ruminantium
  MG15-147 effector
SDDYKMTISREMLLQEIRSLFASQRNYGNPYASKDFEEAYTSIFLSQRNFDEGPGEGSPYAGNQIEKMIGKCTLEGGELRAPKASYSFMQFNLLQKLCHIRIRGKAGERALTADEIKRLESLAWSNASLNYGHFRKELCLADTERFTDVYYKTEDFVQEEKKNKIKITAAYHEIAKALKDKGKDYIATLSIDQLDAIAYAFSAYKSDSKIRDYMQAKGVLSEDVDLLLANLSGFSKFGHISIKACRKLIPYLKKGMGYIKACEAAGYKDKLVQKKKTLSGNIEEVQEIPNPVVKRAVSQTIKVINAIVRKYGSPVEIHIELAREMARSKKDRDAMTTSMEKNRAENETIKRELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDLIEKYLEMAPFNTNRKRHVVAVNGAVTAYVRKRLGIAKIREDGDLHHAVDAAVIACVTEGMINRISRYSKRREILYNNKLVDEETGEIIKGKEDFPEPWPWFRKELDARTSKNPALLLREMKLPTYTEAELENLREPYVSRMPCHKVRGAGHESKIRSPRLLKDGKTAIKTPLVELKLTNDKTKIAGYVNPESDKLLYDALYERLCKFGGKAEKAFAEPFYKPKADGGQGPLVKSVKISKLSTMNVELNKGNGIADNERRVRVDVFYVSEGKKKGYYLVPIYVADTIKPVLPKKAVKAHKAYDEWEEMKAEDFSFSLYPNDLIYIEHKTGIKFSLISKNSTLSKEINVKKGYFYYRGMDIAAGAINIENFDGVYQARGLGVKTLNCLRKGEIDILGNIRLINREYRHCFTKMKRDRYKKE

SEQ ID NO: 1075 - protein, 1098 aa, Unknown
  Description of Unknown: uncultivated organism with predicted taxonomy: Selenomonas sp. AE3005
  MG15-148 effector
MEQRYILGLDIGIASVGWAALALNDKDEPYRILDMNSRIFPEAEQPETGESLAAPRRQARGMRRRLRRRRHRLARLRSLLVREGVLSKAALAALYEKPVTDIYAVRCEGLERRLTPEEWTRVLLYFAKHRGFKSNRLAEAGNAEEGQVKEALKANAELLADYRTVGEMLYKDAKFQAHKRNKAAAYQMTVSRNMLLSEIKQLFAAQREQNNEHASEQFEEKYVEVFSSQRNFDEGPGGESPYGGNLIERMIGTCTLERAAGEKRAPKASYSFMRFSLLEKLSHIRITANGATRSLTDEERQQLEQLAWQSPSLTYAHLRKALGLHETERFNDLYYSKDIAETEKKKKFGFTAAYHEVRKALDKLEKDYIKKLSPDELDVIGYAFSVFKNEGNLRSYLLNNGIADEVCSTLLVNLKPFRKFGHISVKACRKLIPYLEQGMTYDAACRAAGYEPSGDNGLKHKFLSGAMEEVREIPNPVVRRAISQTIKVLNALIRRYGSPVEIHVELAREMARNFQDRRDMQHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKLNAFVCWANTSIRDLRKRQNLLRKNFHSEEKEWKDRHLNDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWQGFRKELEARTSDNPAEELRRVQVKNYTEEELQAVKPIFVSRMPRRKIRAAAHEATIHSAKHLNEGITVVKKKLSELKLTNDKMAIAGYFNPSSDKLLYQALLTRLQAFAGNAKKAFAEPFYKPRADGSPGPLVRSVKIAAKSVLQVDVNKGKGVAANDSMVRVDVFYRAEGKGKGYYLVPVYVADTVKDELPVKAVTRRKAYKDWDEMKSDEFLFSLYKDDLLLVRSAKDIELSFLGRKGESGNLLTTYKTREFLCYYQGTNRAACSITICNQDNTYAKESMGIKTLALLKKMQVDVLGQVSEAPAEKRQGFKQMKKDPHRRCGKNVSAPDD

SEQ ID NO: 1076 - protein, 1039 aa, Unknown
  Description of Unknown: uncultivated organism with predicted taxonomy: Selenomonas ruminantium
  MG15-149 effector
MDLRYVLGLDIGIASVGWAVLALDDNDEPYKIEALNSRIFEKAENPKDGSSLAAPRREARSMRRRLRRRRHRSERVRHLLVREGVLSAEEAESLCSSAIPKNAVRGKGLHALRYEGLDRKLSPVEWSRVLLYFAKHRGFKSNRKNGTADKDEGRVLQAIAVNMELLSKYRSAGEMLYLDERFKARKRNASDDYKMTISRDMLLQEIRILFASQRNYGNPYASEGLEEAYATIFLSQRNFDEGPGEGSPYAGNQIEKMIGKCTLEGEELRAPKASYSFMRFNLLQKLSHIRIRGKVGERALTEEEIKRLESLAWSNASLNYGHFRKELGLADTDRFADVYYKTEDFVQEEKKNKIKITASYHEIAKALKDKGKEYITTLSIDQLDAIAYAFSAYKSDSKIRAYMQAKGVSSEDAALLLANLSGFSKFGHISIKACRKLMPYFEKGMGYIKACEAAGYKDKLVQKRKTLSGNIKEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKGKEDFPEPWPWFRKELDARTSKNPALLIRGLKLPTYAEEELENLHEPYVSRMPCHKVRGAGHKDTIRSPRLREEGRSVTKKALTELKLTKDKIRIEGYVNPESDRLLYEALYEKLCQFDGDAKKAFSAPFYKPKADGGQGPLVKKVKISEVSTLNVSVHKGKGIADSDRMLRVDVYYVSEGKKKGYYLVPIYVADTLKPVLPNKAVKAHKVYDEWEEMNVEDFVFSLYPNDLVYIEHKSGFKLKVVSKKSTLQNEMYGKTGVFYYCS

SEQ ID NO: 1077 - protein, 786 aa, Unknown
  Description of Unknown: uncultivated organism with predicted taxonomy: Selenomonas ruminantium
  MG15-150 effector
WDKKPEEIEKKKLPFAAPYHEIRKALDKREKGRIQKLTPGALDAIGYIFTVFKNDTKIAAALKEAGIDEADAAALMDYGLTFQGFGHISVKACRKLIPHLETGMTYDKACKEAGYDFHGKSGEKAKLLSGNLEEIREIPNPVVRRAIAQTVKVVNAVIRRYGSPVAVNVELAREMGRTFQERREMMKSMEDNNTKNEKLKEELKDYGVAHPSGLDIVKLKLYKEQGGVCAYSLAAMPIEKVLNDYDYAEVDHILPYSRSFDDSYANKVLVLAKENRDKGNRTPMEYMEKTPGKKHDFVTWVKASVRNPKKRDNLLLEKFDEDKEAAWKERHLTDTKYIGSFVANLLRDHLDFAPWLNGRKQHVLVVNGAVTDYTRKRLGIRKIREDGDLHHAVDAAVIATVTQGNIQKLTNYSKQIERSRAFDKTANGSYADRETGEVLKKDELMVRMSKHFPEPWPGFRHELEARVSDHPKELLESLRLPTYTPEELDALKPPFVSRMPTRKVRGAAHLETVVSPRLQKEGLIVKKVSLEALKLTKEKDAIENYYAPESDRLLYEALLQRLKACDGDGKKAFAEPFHKPKADGTPGPVVKKVKIAEKSTLSVPVHHGRGLAANGGMVRVDVFFIPEGKEKGYYLVPVYTSDVVCGALPMRAVIGAKPYDEWKNMKEEQFLFSLYPNDLVYIESKRGIKGKLPDKMAKKSSLLQTRTQTEGLFYYKGTDIFTASIKVVATDGTYEFRGLGVRTLQKLEKWTVDVLGGALHPLHQEVRQGFSVMKRDPHSPKTMDDC

SEQ ID NO: 1078 - protein, 1098 aa, Unknown
  Description of Unknown: uncultivated organism with predicted taxonomy: Selenomonas sp. AE3005
  MG15-151 effector
MEQRYILGLDIGIASVGWAALALNDKDEPYRILDMNSRIFPEAEQPKTGESLAAPRRQARGMRRRLRRRRHRLARLRSLLVREGVLSKAALAALYEKPVTDIYAVRCEGLERRLTPEEWTRVLLYFAKHRGFKSNRLAEAGNAEEGQVKEALKANAELLADYRTVGEMLYKDAKFQAHKRNKAAAYQMTVSRNMLLSEIKQLFAAQREQNNEHASEQFEEKYVEVFSSQRNFDEGPGGESPYGGNLIERMIGTCTLERAAGEKRAPKASYSFMRFSLLEKLSHIRITANGATRSLTDEERQQLEQLAWQSPSLTYAHLRKALGLHETERFNDLYYSKDIAETEKKKKFGFTAAYHEVRKALDKLEKDYIKKLSPDELDVIGYAFSVFKNEGNLRSYLLNNGIADEVCSTLLVNLKPFRKFGHISVKACRKLIPYLEQGMTYDAACRAAGYEPSGDNGLKHKFLSGAMEEVREIPNPVVRRAISQTIKVLNALIRRYGSPVEIHVELAREMARNFQDRRDMRHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKLNAFVCWANTSIRDLRKRQNLLRKNFHSEEKEWKDRHLNDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWPGFRKELEARTSDNPAEELRRVQVKNYTEEELQAVKPIFVSRMPRRKIRAAAHEATIHSAKHLNEGITVVKKKLSELKLTNDKMAIAGYFNPSSDKLLYQALLTRLQAFAGNAKKAFAEPFYKPRADGAPGPLVRSVKIAAKSVLQVDVNKGKGVAANDSMVRVDVFYRAEGKGKGYYLVPVYVADTVKDELPLKAVTQRKDYADWEIMRSKDFLFSLYKDDLLLVRSTKDIEMKFNEKKKEKSTLPAIFRTREVFAYYQGTDSSTASITVCNHDNTYGKRGMGVKTIALLKKMQVDVLGQISEAPAEKRQGFKQMKKDPHRRCGKNVSAPDD

SEQ ID NO: 1079 - protein, 1100 aa, Unknown
  Description of Unknown: uncultivated organism with predicted taxonomy: Selenomonas sp. AE3005
  MG15-152 effector
MEQRYVLGLDIGIASVGWAALALNDKDEPYRILDMNSRIFPVAEQSDGASLAAPRRQARGIRRRLRRRRHRLDRVRRLLVREGVLNKAGLTALYEKPVTDIYVIRYEGLERRLTPEEWARVLLFFVKHRGFKSNRLAETANDEDGQVKAALKANEELLVGYRTVGEMLYKDAKFQGHKRNKTADYQMTVSRNMLLEEIKQLFVAQREQNNGHATESFEEKYVEIFSSQRNFDEGPGGDSPYGGNLIEKMIGACTLERANGEKRAPKASYSFMRFNLLEKLSHIRITANGTMRSLTDEERRQLEQLAWRSPSLTYAHLRKALGLQETERFNDLYYSKDTAETEKKAKFSFTAAYHEIRKALDKVEKDYIKKLSPNELDVIGYAFSVFKNERNLRSYLLNNGITENICSTLLDNLKPFRKFGHISVKACRKLIPYLEKGMTYYDACKAAGYDILGKNSRKQKFLSGGMEEVREIPNPVVRRAISQTIKVLNALIRRYGSPVEIHVELAREMARSFQDRKDMHNKMENNRKANEQIIKELRENGLLQPNGLDIVKWKLYKEQQGVCAYSQKTFDVERLLHDGKYDGKYAEVDHILPYSRSFDDSYTNKVLVMAGENQHKGNRTPWEYMRDNEEKWTSFACWTNTAIRDFRKRQNLLRKNFCSEEKEWKERHLNDTKYISRFVYNLLRNHLEFNPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALKPIFVSRMPRRKVRAAAHEETIRSAKHLDEGFTVVKKKLSDLKLTKDKMAIEGYFNPSSDTLLYQALLERLQKFDGKAAKAFAEPFYKPKADGTPGPLVRTVKIAAKSVLQVDVNKGKGVTDNESMVRVDIFYRAEGKRKGYYLVPVYVADTIKDELPIKAVTRGKPHKDWEEMNPDEFQFSLYKDDLLLVRSTKDIDMKFNEKNGEGALPPIFRTREVLVYYQATDRATASITVCNHDNTYGKRGMGVKTIALLKKMQVDVLGQVSEFPPMKRQGFKQMKKDPHRRCDRNVSASND

SEQ ID NO: 1080 - protein, 999 aa, Unknown
  Description of Unknown: uncultivated organism with predicted taxonomy: Selenomonas sp. AE3005
  MG15-153 effector
VTDIYAIRYEGLERRLTTEEWARVLLFFVKHRGFKSNRLAETANDEDGQVKDAIKANAELLVGYRTVGEMLYKDAKFQGHKRNKTADYQMTVSRNMLLEEIKQLFVAQREQNNGHATESFEEKYLEIFSSQRNFDEGPGGNSPYGGNLIEKMIGVCTLERANGEKRAPKASYSFMRFSLLEKLSHIRLTANGTTRSLTDEERSRLEQLAWQSPSLTYAHLRKALGLQETERFNDLYYSKDTAETEKKAKFSFTAAYHEIRKALDKLEKDYIKKLSPNELDVIGYAFSVFKNERNLRSYLLNNGITENVCSTLLDNLKPFRKFGHISVKACRKLIPYLETGMTYYDACKAAGYDVLGKNGCKEKFLSGGMEEVREIPNPVVRRAISQTIKVLNALIRRYGSPVEIHVELAREMARSFQDRRDMHNKMENNRKANEQIIKELRENGLLQPNGLDIVKWKLYKEQQGICAYSQKTFDVERLLHDGKYAEVDHILPYSRSFDDSYTNKVLVMAGENQHKGNRTPWEYMRDNEEKWTSFACWTNTAIRDFRKRQNLLRKNFCSEEKEWKERHLNDTKYISRFVYNLLRNHLEFSPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALNPIFVSRMPRRKVRAAAHEETIRSAKHLDEGFTVVKKKLSDLKLTKDKMAIEGYFNPSSDTLLYQALLERLQKFDGKAAKAFAEPFYKPKADGTPGPLVRTVKIAAKSVLQVDVNKGKGVTDNESMVRVDVFYRSEGKGKGYYLVPIYVADTVKDELPLKAVTPRKCYMDWETMKPEEFLFSLYKDDLLLVCSSKDIDMKLNEKNGEGVLPPIFRTREVLVYYQATDRATASITVCNHDNTYGKRGMGVKTIALLKKMHVDVLGQVSEFPPMKRQGFKQMKKDPHRRCDRNVSASND

SEQ ID NO: 1081 - protein, 963 aa, Unknown
  Description of Unknown: uncultivated organism with predicted taxonomy: Selenomonas ruminantium
  MG15-154 effector
KDGSSLAAPRREARSMRRRLRRRRHRSERVRHLLVREGVLSAEGAESLCSSAIPKNAMLGKGLHALRYEGLDRKLSPVEWSRVLLYFAKHRGFKSNRKNGTADKDEGRVLQAIAVNMELLSKYRSAGEMLYLDERFKARKRNASDDYKMTISRDMLLQEIRILFASQRNYGNPYASEGVEEAYTTIFLSQRNFDEGPGEGSPYAGNQIEKMIGKCTLEGEELRAPKASYSFMRFNLLQKLSHIRIRGKVGERALTEEEIKRLESLAWSNASLNYGHFRKELGLADTDRFADVYYKTEDFVQEEKKNKIKITAAYHEIAKALKDKGKEYITTLSIDQLDAIAYAFSAYKSDSKIRAYMQAKGVSSEDAALLLANLSGFSKFGHISIKACRKLMPYLEKGMGYIKACEAAGYKDKLVQKRKTLSGNIEEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKEKEDFPEPWPWFRKELDARTSKNPALLIRELKLPTYAEEELENLHEPYVSRMPCHKVRGAGHKDTIRSPRLRKEGRSVTKKPLTELKLTKDKTKIEGYVNPESDRLLYEALYEKLCQFDGDAKKAFSAPFYKPKADGGQGPLVKKVRISEVSTLNVAVHKGKGIADSDRMLRVDVYYVSEGKKKGYYLVPIYVADTLKPVLPNKAVKAHKACDEWEEMKAEDFSFSLYPNDLIYIEH

SEQ ID NO: 1082 - protein, 910 aa, Unknown
  Description of Unknown: uncultivated organism with predicted taxonomy: Selenomonas sp. AE3005
  MG15-155 effector
KANEELLTGYRTVGEMLYKDAKFQGHKRNKTADYQMTVSRNMLLEEIKQLFVAQREQNNGHATESFEEKYLEIFSAQRNFDEGPGGNSPYGGNLIERMIGTCTLERASGEKRAPKASYSFMRFSLLEKLSHIKIKTNGTTRSLTSEERRQLEQLAWQSPSLTYAHLRKALGLQDTERFNDLYYTKDIAGTEKKTKFGFTVAYHEIRKALDKMEKAYIKKLSPEDLDVIGYAFSVFKNEGNLSAYLLNHGITKDVCSILLANLKPFRKFGHISVKACRKLIPYLEQGMTYYDACIAAGYDVAGKNSRKQKFLSGGMEEVREIPNPVVRRAISQTIKVLNALIRRYGSPVEIHVELAREMARSFQDRKDMHNKMENNRKANEQIIKELRENGLLQPNGLDIVKWKLYKEQQGVCAYSQKTFDVERLLHDGKYAEVDHILPYSRSFDDSYTNKVLVMAGENQHKGNRTPWEYMSNNEEKWTAFACWTNTAIRDFRKRQNLLRKKFCSEEKEWKERHLNDTKYISRFVYNLLRNHLEFSPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALKPIFVSRMPRRKVRASAHEDTIRSAKYLDEGFTIVKKKLSDLKLTKDKMAIEGYFNPSSDTLLYQALLKRLQEFDGKAAKAFADPFYKPRADGTPGPLVRTVKIKTKSVLQVDVNKGKGVTDNKSMVRVDIFYRAEGKRKGYYLVPVYVADTIKDELPIKAVTKGKAYKDWDEMKPDEFLFSLYKDDLLLVRSVKDIELSFLGKKGELGNFLPTYKTREFLCYYQGTNRGACSITICNQDNTYAKESMGIKTLALLKKMQVD

SEQ ID NO: 1083 - protein, 1111 aa, Unknown
  Description of Unknown: uncultivated organism with predicted taxonomy: Selenomonas sp. AE3005
  MG15-156 effector
YLFINEIEMGRKVMEQRYILGLDIGIASVGWAALALNDKDEPYRILDMNSRIFPEAEQPKTGESLAAPRRQARGMRRRLRRRRHRLARLRSLLVREGVLSKAALAALYEKPVTDIYAVRCEGLERRLTPEEWTRVLLYFAKHRGFKSNRLAEAGNAEEGQVKEALKANAELLADYRTVGEMLYKDAKFQAHKRNKAAAYQMTVSRNMLLSEIKQLFAAQREQNNEHASEQFEEKYVEVFSSQRNFDEGPGGESPYGGNLIERMIGTCTLERAAGEKRAPKASYSFMRFSLLEKLSHIRITANGATRSLTDEERQQLEQLAWQSPSLTYAHLRKALGLHETERFNDLYYSKDIAETEKKKKIGFTAAYHEVRKALDKLEKDYIKKLSPDELDVIGYAFSVFKNEGNLRSYLLNNGIADEVCSTLLVNLKPFRKFGHISVKACRKLIPYLEQGMTYDAACRAAGYEPSGDNGLKHKFLSGAMEEVREIPNPVVRRAISQTIKVLNALIRRYGSPVEIHVELAREMARNFQDRRDMQHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKQNAFVCWANTSIRDLRKRQNLLRKNFHSEEKEWKDRHLNDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWPGFRKELEARTSDNPAEELRRVQVKNYTEEELQAVKPIFVSRMPRRKIRAAAHEATIHSAKHLNEGITVVKKKLSELKLTNDKMAIAGYFNPSSDKLLYQALLTRLQAFAGNAKKAFAEPFYKPRADGSPGPLVRSVKIAAKSVLQVDVNKGKGVAANDSMVRVDVFYRAEGKGKGYYLVPVYVADTVKDELPLKAVTQRKDYADWEIMRSKDFLFSLYKDDLLLVRSTKDIEMKFNEKKKEKSTLPAIFRTREVFAYYQGTDSSTASITVCNHDNTYGKRGMGVKTIALLKKMKVDVLGQVSEAPAEKRQGFKQMKKDPHRGCGKNVSAPDD

SEQ ID NO: 1084 - protein, 861 aa, Unknown
  Description of Unknown: uncultivated organism with predicted taxonomy: Megasphaera stantonii
  MG15-157 effector
EQPKTGASLAAPRREARGSRRRTRRRRHRMERLRHLFVREGLMTADTLAALFEAPADVYQLRAEGLSRRLDAGEWARVLYHIAKHRGFKSNRKSAASDADEGKVLDAVKENAELLKNYKTVGEMLFRDEKFRDAKRNKGGSYSFCVGRDMLADEIAALFDAQRRNGNQHASEEFEKACLKIFADQRSFDDGPDINSPSPYAGNQIEKMIGSCSLEPKEKRAPKASYSFMRFSLLQKINHLRLKDAKGEERPLDDEERAAVEALAWKSASLTYGAIRKALSLSDDLRFTDLYYRWDKKPEEIEKKKLPFAAPYHEIRKALDKREKGRIQKLTPDALDAIGYIFTVFKNDTKIAAALKTAGVEEEDAAALMDYGLTFRGFGHISVKACRKLIPYLEKGMTYDKACKEAGYDLQKTGGEKTKLLSGNLEEIREIPNPVVRRAIAQTVKVVNAVIRRYGSPVAINVELAREMGRSFQERRDMMKSMEDNNAENEKRKEELKGYGVAHPNGLDIVKLKLYKEQGGVCAYSLAAMPIEKVLKDPSYAEVDHILPYSRSFDDSYANKVLVLAKENRDKGNRTPMEYMANLPERKHAFITWVKSNVRNPKKRDNLLLEKFDGDKEDAWKERHLNDTKYISSFVKNLLEDHLEFAPWLTGRKRHVMAVNGAVTDYTRKRLGIRKIREDGDLHHAVDAAVIAIVTQGNIQKLTNYSKRIEHAFIKNRDGSYTHPDTGEILKKDELMAQMSRHFPEPWPGFRRELEARVSDHPKELLESLRLPTYTPEEIDALKPPFVSRMPTRKVRGAAHLETVVSPRLQKEGLIVKKVSLDALKLTKEKDAIENYYAPESDRLFYEALLQRLQACDGNGK

SEQ ID NO: 1085 - protein, 764 aa, Unknown
  Description of Unknown: uncultivated organism with predicted taxonomy: Selenomonas ruminantium
  MG15-158 effector
YYKTEDFVQEEKKNKIKITAAYHEIAKALKDKGKEYITTLSIDQLDAIAYAFSAYKSDSKIRAYMQAKGVSSEDAAILLANLSGFSKFGHISIKACRKLMPYLEKGMGYIKACEAAGYKDKLVQKRKTLSGNIEEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTTRKRNVVAVNGAVTAYVRKRLGIAKIRENGDLHHAVDAAVIACVTEGMINRISRYSKRREILYNNKLVDEETGEIIKGKEDFPEPWPWFRKELDARTGKNPALLIRDLKLPTYTEAELENLHEPYVSRMPCHKVRGAGHEAKIRSPRLLKDGKTAIKTPLVKLNLTNDKTKIAGYVNPESDKLLYDALYERLCKFGGKAEKAFAEPFYKPKADGGQGPLVKSVKISKSSTMNVELNKGNGIADNERRVRVDVFYVSEGKKKGYYLVPIYVADTIKPVLPNKAVKAHKACDEWEEMKAEDFSFSLYPNDLIYIEHKTGIKFSLISKNSTLSKEINIKKGYFYYRGMDIAAGAINIENVDGVYQARGLGVKTLNCLRKGEIDILGNIRLINREYRHCFTKMKRDRYKKE

SEQ ID NO: 1086 - protein, 1102 aa, Unknown
  Description of Unknown: uncultivated organism with predicted taxonomy: Selenomonas ruminantium
  MG15-159 effector
MDLRYVLGLDIGIASVGWAVLALDDNDEPYKIEALNSRIFEKAENPKDGSSLAAPRREARSMRRRLRRRRHRSERVRHLLVREGVLSAEGAESLCSSAIPKNAMLGKGLHALRYEGLDRKLSPVEWSRVLLYFAKHRGFKSNRKNGTADKDEGRVLQAIAVNMELLSKYRSAGEMLYLDERFKARKRNASDDYKMTISRDMLLQEIRILFASQRNYGNPYASEGLEEAYATIFLSQRNFDEGPGEGSPYAGNQIEKMIGKCTLEEEELRAPKASYSFMRFNLLQKLSHIRIRGKVGERALTEEEIKRLESLAWSNASLNYGHFRKELGLADMDRFADVYYKTEDFVQEEKKNKIKITAAYHEIAKALKDKGKEYITTLSIDQLDAIAYAFSAYKSDSKIRAYMQAKGVSSEDAALLLANLSGFSKFGHISIKACRKLMPYLEKGMGYIKACEAAGYKDKLVQKRKTLSGNIEEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKEKEDFPEPWPWFRKELDARTSKNPALLTRELKLPTYAEEELENLHEPYVSRMPCHKVRGAGHKDTIRSPRLRKEGRSVTKKPLTELKLTKDKTKIEGYVNPESDRLIYEALYEKLCQFDGDAKKAFSAPFYKPKADGGQGPLVKKVKISEVSTLNVSVHKGKGIADSDRMLRVDVYYVSEGKKKGYYLVPIYVADTLKPVLPNKAVKAHKVYDEWEEMNVEDFVFSLYPNDLVYIEHKSGFKLKVVSKKSTLQNETYGKTGVFYYCSMNISTGALNLENLDGTYQVESLGVKTLICLRKGEIDTLGNIRLLENEVRKGFSYMKKDRYRKV

SEQ ID NO: 1087 - protein, 911 aa, Unknown
  Description of Unknown: uncultivated organism with predicted taxonomy: Megasphaera stantonii
  MG15-160 effector
RRRTRRRRHRMERLRHLFVREGLMTADALAALFEAPADVYQLRAEGLSRRLDEGEWARVLYHIAKHRGFKSNRKSAASDADEGKVLDAVKENAELLKNYKTVGEMLFRDEKFRDAKRNKGGSYSFCVGRDMLADEIAALFDAQRRNGNKHASEEFEKACLKIFADQRSFDDGPDINSPSPYAGNQIEKMIGSCSLEPKEKRAPKAGYSFMRFSLLQKINHLRLKDAKGEERPLDDEECAAVEALAWKSASLTYGAIRKALSLSDDLRFTDLYYRWDKKPEEIEKKKLPFAAPYHEIRKALDKREKGRIQKLTPDALDAIGYIFTVFKNDTKIAAALKTAGVEEEDAAALMDYGLTFRGFGHISVKACRKLIPHLEKGMTYDKACKEAGYDLQKTGGEKTKLLSGNLEEIREIPNPVVRRAIAQTVKVVNAVIRRYGSPVAINMELAREMGRSFQERRDMMKSMEDNNAENEKRKEELKGYGVAHPNGLDIVKLKLYKEQGGVCAYSLAAMPIEKVLKDPSYAEVDHILPYSRSFDDSYANKVLVLAKENRDKGNRTPMEYMANLPERKHAFITWVKSNVRNPKKRDNLLLEKFDGDKEDAWKERHLNDTKYISSFVKNLLEDHLEFAPWLTGKKRHVMAVNGAVTDYTRKRLGIRKIREDGDLHHAVDAAVIAIVTQGNIQKLTNYSKRIEHAFIKNRDGSYTHPDTGEILKKGELMAQMSRHFPEPWPGFRRELEARVSDHPKALLESLRLPTYTPEELDALKPPFVSRMPTRKVRGAAHLETVVSPRLQKEGLIVKKVSLDALKLTKEKDAIENYYAPESDRLLYEALLRRLKEFDGDGKKAFAEPFHKPKADGTPGPVVKKVKIAEKSTLSVPVHHGRGLAANGGMVRVDLFFIPEGKERGYYLVPVY

SEQ ID NO: 1088 - protein, 1112 aa, Unknown
  Description of Unknown: uncultivated organism with predicted taxonomy: Selenomonas sp. AE3005
  MG15-161 effector
MDRRYALGLDIGIASVGWAVLALDDADNPYRIINMGTRIFDAAEHPKDGASLAAPRREARSARRRLRRRHHRIERTRKLLIREGLLTKDALQHLFDAPPEKDVYTLRFEGLECCLDGEEWARVLLFFSKHRGFRSNRIVDDEAGDEGKVLSAIRQNEERLQGYRTVGEMLARDPKFADRKRNKAEDYQLTVSRTMLEKEICTLFDAQRQWKNPHASEDFEQEYLEIFSSQRHFDEGPGGRSPYGGDQIEKMIGRCTLEPKEKRAPKASYSFQRFSLLQNINHLRIKSQNTERSLSDEERKAVEALCWKSPSVTYYKIRQEVNLPDDARFAGLYYDKAPEEVEKKTKFSYTVPYHEIRKVLDKWKKGGIQELDVHQLDTIGYAFTVYKNDDRIHRYLCGHGISDAIAEVLVQNLKSFQKFGHISLKACQKLIPFLEQGMVYSDACKAAGYAAPDAEPKKFLSGGMEEIREIPNPVVRRSLSQTVKIINAVIREYGSPVEVHIELAREMARSRQDRDKMEKDIKNNRARNEAIKKELQELGLRNPKGQDIIKWRLYKEQDGFCAYSQKQFDVERLLHDGSYAEIDHILPYSRSFDDSYHNKVLVMAAENRQKGNRTPLEYMAGEEERIHAFRIWVNSRIHDFRKRQNLLREHFDKESTEKDWKERNLNDTKYISRFIYNLIRQHLQFAPFRTDRKQHIISVNGAVTSYIRKRLGIPKIREDGDLHHAVDAVVIASITQGTIQKVTRYSREKETLYHCDSKGRLIDTSTGEILSPEEHQRRLAEKFPEPWPCFRKEIEARISHHPAENLRLLHLPTYTEEELAELEKPIFVSRMPNHKVRGAAHEKSLRSPRLQEDGIIVYSTPLTKLKLGKDNNSILNYYNPDSDRLLYTALLQRLQKFQGDAEKAFKEPFHKPKADGTLGPVVRKVKVTDKSNLNVSLNHGHSIAKNDSDGGMVRVDVYYIPDGKKHGYYLVPVYVSDVVRKTLPNKAIVADTPYAEWPEMREEDFLFSLYKNDLIHLRKKKPAKMKVIQKESTLQKEIAVSEGNAYYISTDSATASIKIINHDNTYYTKGLGVKTLLSLEKMQVDVLGNITPAPREPRQDFSAMKRDRFARK

SEQ ID NO: 1089 - protein, 1082 aa, Unknown
  Description of Unknown: uncultivated organism with predicted taxonomy: Megasphaera
  MG15-162 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 1090 - protein, 767 aa, Unknown
  Description of Unknown: uncultivated organism with predicted taxonomy: Megasphaera stantonii
  MG15-163 effector
LREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAMILRYGNPVEVHIELARELARNFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIWNSRKRENLLRIDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVKHDETYKARGIGIQSLRKNKKCCIDVLGNISFASKEKRQTFR

SEQ ID NO: 1091 - protein, 1038 aa, Unknown
  Description of Unknown: uncultivated organism with predicted taxonomy: Megasphaera
  MG15-164 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGFRYDLKKGKAENLEEPVSEAEKMSFSWVKDYHSIRKALDKVEKNRILKLSHEQLDTIATAFSVYKNEETIEKYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYGGKAKEAFKEPFHKPKADGTPGPIVNKVKIMEKSTMPVPVNGGKGLASNGNMVRIDVFRSEEKGKKKYYFIPIYVADTVKEELPNRAALAHKPYEAWKIMKEEDFIFSLYPNDLIFVDAGKEIPFKAALKGSTLDPEKKASRFLMYYKGADIAGGTIN

SEQ ID NO: 1092 - protein, 846 aa, Unknown
  Description of Unknown: uncultivated organism with predicted taxonomy: Megasphaera stantonii
  MG15-165 effector
ENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 1093 - protein, 1227 aa, Unknown
  Description of Unknown: uncultivated organism with predicted taxonomy: Bacteroidales
  MG16-2 effector
MKRILGLDLGTNSIGWALVEVDEDGKIIKILGIGSRIIPLSPDDANEFTTGKSITKNRKRTEQRTTRKCFDRYQLRRLLLTIELRKFNMLPDERLIKLPVLDLWQLRAKAATKGNRLTLPELGRVLYHLNQKRGYKHAKSDESNDKNQREYVANVNTRYANIKQLGKTIGQFFAEKLEENQVITEKGKFYTYRIKDQVFPRKAYEEEFDQIMECQREFYPEILTDKFIDKVRNEIIYYQRKLKSCKHLVSLCEFEKRAYVNKDGKVVYDGPKVAPRTSPLFQVCKIWESVNNLKIKNRKNDELYITQEQRIAMFNFLNNNEKMTLSDMYKILKIDKSDGWWGGKAIGNGLQGNTTKMQLKKALSNCQNVDELLQFNLDIVDSDKIDEETGEVLKVVSPNCEQEPLYKLWHTIYSIQDKNELKNVLQKKWGITDETTLNSLFALDFVRPGYGNKSSKFIRKILPYLQDGLMYNEACAYIGVNHSNSLTKAENDARELLEKLPQIKKNELRQPVVEKILNQMINVVNAIFDKYGNNNGIDEIRVELARELKQSREERELTDKNNRNRQKENDSNAKLIEEYGIRASRNRIQKYRMWKESRQTCFYCGQVVDVKDFLRGYDVEVEHIIPKALFFDDSFSNKVCSCRKCNSEKGERTAYDYMSSKGEDELNRYIRTVEDRCKKGEISKTKRERLLTPADKIPTDFINRQLRETQYIAKKSVEILKQICRNVWTTSGSVTDFLRHNWGYDEILHTLDFDRYKSGGLTEVIEIEHKGQKHRIERIKDWSKRLDHRHHAVDALVVACTKQSYIQRLNNLNTERDAMYQDIEAQSVEWKEKHSLLEKWIKLQPHPTVSEVTDKVDEILVSFKAGKRVATLGKRSVYKNGKKTVVQNNIIVPRGALCEESVYGQINLIEKNKPIKYLFENPSLIFKPYIKALVEERLKEYNGDTSKAISSLKNNPIYLRKDKSVVLEYGTCYKKEYVKKYSLNSIKAKDVDSIIDKHIREVVRQRLEDNNNNEKAAFASPLYADKQKQIPIKSVRCTTGINIAAPVNYNESNDPISFVKPGNNHHIAIYKDKDGKRQEHIVTFWHAVERKKYGMPVVITNPKEIWDLIIEKSLDLPESFLNCLPNSDWNYEISMQQNEMFVMGMSEDEFQDAIRNNDYKTLNKYLYRVQSVSESDYWLRLHIETMNDKTPEGNIIKKYYRIKSINTFFNFNPHKVKITLLGEIQSS

SEQ ID NO: 1094 - protein, 1165 aa, Unknown
  Description of Unknown: uncultivated organism with predicted taxonomy: Bacteroidales
  MG16-5 effector
MATKKILGLDLGTNSIGWALIETEDSNPKSILAMGSRIVPLSTDDSTQFAKGQAITKNADRTQKRTARKGLNRYQMRRAMLTEELRRHGMLPERTDENIMDLWRLRSDAATDGKQLSLPQIGRVLYHINQKRGYKHSKADNSANTKQTKYVEAVNQRYRDIQACHQTIGQYFYEQLLSSAVQTPSGSYYTYRIKDKVLPREAYIAEFDQIMKVQRVFYPDVLTDELVDTLRNHIIFYQRPLKSCKHLVSLCEFEKRPFKREDGQIVYSGPKCAPRTSPLAQFCTVWEAVNNITLTNRQNETFEITQEQRVAMADFLNQHDKMGVKDLQKILGISPKDGWWAGKAIGKGLKGNTTFTQLREALGNLPNAEHLLKMKLSMVDAAVDTTTGELIRQVSPQVEEEPLFRLWHLVYSLQNEDELRKALRKQFGIDDEEVLDKLCKIDFVKPGYANKSHKFIRKLLPYLMEGYQYHEACAHIGVNHSDSLTAEQNAARPLLDKIPLLEKNELRQPVIEKILNQMINVVNALKAEYGDIDDVRIELARELKSSKDEREAAFKRNNENERQNKIYENRIREYGIQPSRSRIQKYKMWEESNHLCFYCGKPVNVTDFLAGAEVEIEHIIPQSVLFDDSYSNKVCACRACNQAKGNLTAREFMEKHSKEEYDSYLRRVDDAFNAHRISKTKRDHLLWRKEDIPQDFIDRQLLQSQYIAKKAAEILRQGYRNVYATSGSVTDFLRHQWGYDEILHRLNLPRYQQVEGLTEDVTYDHCGQEHQQERIKGWTKRLDHRHHAIDALTIALTQQSVIQRLNTLNNSREQMFDELGKRTDTPEYTEKRSLLEKWVDAQPHFSVQEVTDKVDGILVSFRAGKRAATPAKRAVYQNGKRHIVQTGLQVPRGALSEETVYGKLGNKYVVKYPLGHQSMKMDDIVDPTIREIVRTRLNAFGGKAKDAFAEPLYSDAAHQMQIKTVRCYTGLQDKAVVPVRFNAQGEPVGFVKMGNNHHIAIYRDAKGQYQESVVSFWQAVERKRYGIPVVIEQPHEVWDKLINSDNIPQDFLETLPHDDWQFVVSLQQNEMFILGMDDADFEAAMEQKDYRTLNKYLYRVQKISSKEYCFRYHTETSVDDKYDGVINKSISMELQKLKRLTSISAFFSQHPHKVRVNLLGEVSAL

SEQ ID NO: 1095 - protein, 1165 aa, Unknown; identical to SEQ ID NO: 1094
  Description of Unknown: uncultivated organism with predicted taxonomy: Bacteroidetes
  MG16-6 effector

SEQ ID NO: 1096 - protein, 1224 aa, Unknown
  Description of Unknown: uncultivated organism with predicted taxonomy: Bacteroides
  MG16-7 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEELDRIVEAQKVFWPDIFTDENVDELRNRIIFFQRPLKSCKHLVSLCDFEVRDFVKKNHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQEHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKDYYFRYQYETQLDDKEAALSMKKFYRVTSLSSLQSLNPKKVSINLLGDISLHNII

SEQ ID NO: 1097 - protein, 1224 aa, Unknown
  Description of Unknown: uncultivated organism with predicted taxonomy: Bacteroides
  MG16-8 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEEFDRIVEAQKVFWPDIFTDENVDELRNRIIFFQRPLKSCKHLVSLCDFEVRDFVKKDHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQKHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKDYYFRYQYETQLDDKEAALSMKKFYRVTSLSSLQSLNPKKVSINLLGDISLHNII

SEQ ID NO: 1098 - protein, 1224 aa, Unknown; identical to SEQ ID NO: 1096
  Description of Unknown: uncultivated organism with predicted taxonomy: Bacteroides sp. CAG:770
  MG16-9 effector

SEQ ID NO: 1099 - protein, 1224 aa, Unknown
  Description of Unknown: uncultivated organism with predicted taxonomy: Bacteroides
  MG16-10 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEEFDRIVEAQKVFWPDIFTDENVDELRNRIIFFQRPLKSCKHLVSLCDFEVRDFVKKNHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQKHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKDYYFRYQYETQLDDKEAALSMKKFYRVTSLSSLQSLNPKKVSINLLGDISLHNII

SEQ ID NO: 1100 - protein, 1224 aa, Unknown; identical to SEQ ID NO: 1099
  Description of Unknown: uncultivated organism with predicted taxonomy: Bacteroides
  MG16-11 effector

SEQ ID NO: 1101 - protein, 1165 aa, Unknown; identical to SEQ ID NO: 1094
  Description of Unknown: uncultivated organism with predicted taxonomy: Bacteroidetes
  MG16-12 effector

SEQ ID NO: 1102 - protein, 1224 aa, Unknown; identical to SEQ ID NO: 1096
  Description of Unknown: uncultivated organism with predicted taxonomy: Bacteroides
  MG16-13 effector

SEQ ID NO: 1103 - protein, 1224 aa, Unknown
  Description of Unknown: uncultivated organism with predicted taxonomy: Bacteroides sp. CAG:770
  MG16-14 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEEFDRIVEAQKVFWPDIFTDENVDELRNRIIFFQRPLKSCKHLVSLCDFEVRDFVKKNHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQEHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKNYYFRYQYETQLDDKEAALSMKKFYRVTSLSSLQSLNPKKVSINLLGDISLHNII

SEQ ID NO: 1104 - protein, 1221 aa, Unknown
  Description of Unknown: uncultivated organism with predicted taxonomy: Bacteroides sp. CAG:770
  MG16-15 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFHQRDLKSCKHLVSQCEFMTRSFLDADHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPTDKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRILAQEGLLIPRGALCEESVYGRIHSLEKEVPVKKLFERVDDIVKPGIRAAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMCVLGMEDDEFRDAMEVKDYKTLGAHLYRVQKLASIYYVFRHQYETQLDDSKGAQIMKKFYRAQSFKALFALHPRKVSVSLLGEMALKDD

SEQ ID NO: 1105 - protein, 1221 aa, Unknown
  Description of Unknown: uncultivated organism with predicted taxonomy: Bacteroides sp. CAG:709
  MG16-16 effector
MKKILGLDLGVGSIGWSLINADKDNKPIAILGLGSRIISLSPDESSEFTSGNAASKNQKRTQKRTARKGYDRYQMRRQALTDKLRELKMLPDEHLIKLPVLDLWTLRARAATPGERLTLPEIGRVLYHINQKRGYRHSRSDDSADKEQREYVQAINKRFQEIREEGVTIGQHFVKKLKESEVVTDKGAFYNYRIKEQVFPRDAYVAEFDKVMDCQKVFYPEELSEANINELRNEIIFYQRNLKSCKHLVSRCEFMTRSFLDEEHRPVLDASGKLVISGPKVAPKSSPIFQVCKIWEEINNLSIRNKENDELHISPEQKKDIFEYLDNNEKITSAALYKILGIGKGDGWSVDKALSKGFTGNTTKVAISKALGKANDAKKRDLLRFDLRLKENGVNKDTGEIVCEIDPECENEPLYKLWHVIYSINDKDAQRHALTNQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIADKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDNVSQILVSFKAGKKVTTPGKRYVYRGGKRILAQEGLLIPRGALCEESVYGRIHSLEKGVPVKKLFERVDDIVKPGIRAAVEERLRACDNDVKVACASLKKEPLYLDAEKTIPLEYGTCYKAEYVMKYALSALKPKDVEYIVDEHIRKVVSERLSEYGNDPKKAFAESLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVTSLQQNEMFVLGMEDDEFRDAMAEADYKALGAHLYRVQKLAGSDYYFRSHYETLLDDSAGARIMKKFYRVRSFNALFNLHPRKVAVSLLGEMSLKND

SEQ ID NO: 1106 - protein, 1221 aa, Unknown
  Description of Unknown: uncultivated organism with predicted taxonomy: Bacteroides sp. CAG:770
  MG16-17 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKVLGKDHNTKKSDLLRFDLRLKENGVNKDTGEIIYEIDPTCENEPLYRLWHVIYSINGKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTQQSIIQRLNNLSAMTAVAGESMSLDKWTLAQPHFSVQKVSDNVSRILVSFKAGKKVTTPGKRYVYRGGKRVLVQEGLLIPRGALCEESVYGRIHSLEKEVPVKKLFERVDDIVKPGIRTAVEERLRACDNDVKVACASLKKEPLYLDVEKTIPLEYGTCYKAKYVMRYALSALKPKDIEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLASIDYYFRSQYETALDNSAGARMMKKFYRINSIKSLFALHPRKVSVSLLGEMALKDD

SEQ ID NO: 1107 - protein, 1220 aa, Unknown
  Description of Unknown: uncultivated organism with predicted taxonomy: Bacteroides sp. CAG:770
  MG16-18 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIEEVLRFDLSAVESNQVNADTGEVLMEISAECEREPLYRLWHIIYSISDKNEQKSALKSQFGILDESMLESLCKIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKTAIGEEQISLDKWTLAQAHFSVADVADHVADILVSFKSGKKVATPGKRYVYKAGRRRVVQENILVPRGALSEESVYGRIKSIEEKIPVKKLFERADDIVKPRIRHLIGERLEACGGDCSKAVSSLRKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISLLGEISLKDD

SEQ ID NO: 1108 - protein, 1220 aa, Unknown
  Description of Unknown: uncultivated organism with predicted taxonomy: Bacteroides sp. CAG:770
  MG16-19 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEISAECESEPLYRLWHIIYSISDKNEQKSALEKQFGITDESMLESLCRIDFVKQGYSGRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAANNIRTRKKVNEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENTISQTKRNRLLTPADKIPKDFIARQLVQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKRVTTPGKRYVYKAGRRIVAQENILVPRGALSEESVYGRIKSIEEKVPVKKLFERADDIVKPRIRRLIRERLETFGGDCSKAVSSLKKSPLYLDEENTIMLEYGSCFKPEYVIKYSLNSIKAKDAVSIVDKHIREVVTARLAAFGDDPKKAFAEPLYSYASGKIQIKTVRCYTGLSQVVPVKRDADGNDIGFVKPGNNHHIAIYKDADGKYQESIVTFCDAVERKKYGIPVDVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 1109 - protein, 1221 aa, Unknown
  Description of Unknown: uncultivated organism with predicted taxonomy: Bacteroides sp. CAG:770
  MG16-20 effector
MKKVLGLDLGVGSVGWSLVNVDDNYKPTEILGIGSRIISLSPDESSEFTSGNAASKNQKRTQKRTARKGYDRYQMRRQALTEKLRELKMLPDEHLIKLPVLELWTLRAKAATPGEKLTLQEIGRVLYHINQKRGYRHAKSDDSADKEQHDYVQTVNKRYQEIKDEGTTIGQHFAIKLKESEIVTDKGPFYNYRIKEQVFPRDAYIEEFDRIMDCQKTFYPEELSEDNIEEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILDIGKGDGWSVDKALSKGFTGNTTKVAIAKVLGKEHNTKKSDLLRFDLRLKENGVNKDTGEIIYEIDPTCENEPLYRLWHVIYSINDKDALRQALTNQFGINDGESLRELTKIDFVKQGYGSRSAKFMRKLLPALMDGARYSEACDMIGINHSGSLTKSENEARELLHTIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMSAVAGESMSLDKWTLAQPHFSVQEVSDNVSRILVSFKAGKKVATPGKRYVYRGSKRILAQEGLLIPRGALCEESVYGRINSLEKGVPVKKLFERVDDIVKPGIRTAVEERLRACDNDVKVACASLKKEPLYLDVEKTIPLEYGTCYKAEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFLDSVERKKYGLPVIIRKPGEIWDILIDKNIPEELAAGLPAPDWQFVMSMQQNEMFVLGMEDDEFMDAMEVKDYKTLGAHLYRVQNISSLYYVLRLQYETQVDNSNEALNMKKFHRIRSFNALFALHPRKVSVSLLGEMALKDD

SEQ ID NO: 1110 - protein, 1218 aa, Unknown
  Description of Unknown: uncultivated organism with predicted taxonomy: Bacteroides sp. CAG:770
  MG16-21 effector
MKKILGLDLGVGSVGWSVVSCDDEHKPVEILGMGSRIVPLTPDESSEFSSGNAASKNQSRTQKRTARKGYDRYQLRRQALTVKLRELGMLPDEALIKLPVLDLWKLRARAATPGEKLSLAEIGRVLYHLNQKRGYRHSKEDDSADKTQRDYVQAVNKRFQEIKDEGLTIGQHFAVKLKESEVITDKGAFYNYRIKEQVFPRAAYVEEFDRIIQCQREFYPEVLTAADVNEIRNEIIYYQRPLKSCKHLVSSCEFMQRELFDAEHNPIRNGKGEIVVAGPKCAPKSSPLAQVCKIWEEINNIRVTNKENDEYFISIDNKHEIFDFLNTHEKMKADDLFKILGIAKNSGWSADRAMSKGMVGNTTRVALMKALKGRRDIDDILRFDLRDVESNQVNADTGEVLMEISAECESEPLYRLWHIIYSISDKNEQKSALKNQFGISDESMLESLCKIDFVKQGYSSRSFKFMRKILPSLMDGAKYSEACDVIGVNHSDSITKAENQARELLARLPQLQKNELRQPVVEKILNQMINVVNAVIDKYGAIDEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYVSRKAMEILNQVCRNVYGSSGDVTAYLRRIWGYDEILHSLDLPRYREGNLTGNVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKSGKRRIAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLDSIKAKDAASIVDKHVREVVTARLAAFGDDPKKAFAEPLYADEAGKIQIKTVRCHTGLSQVVPVKKDADGNDIGFVKPGNNHHIAIYKDADGKYCWNVVTLWNAVDRKRYGLPIIVRNPYEISDIIIDSNVPDELASGLPDPNWSFVMSLQQNEMFVLGMSEEEFRCAIENKDYKTLGMHLYRVQKLSHLRFRSQYETRLDDSNEAKSMKKFYEIRSLKSFWFLNPHKVSISLLGEISLKDD

SEQ ID NO: 1111 - protein, 1220 aa, Unknown
  Description of Unknown: uncultivated organism with predicted taxonomy: Bacteroides sp. CAG:770
  MG16-22 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEINNIRVTNKENDEYFISIDNKHEIFDFLNTHEKMKADDLFKILGLAKNSGWSADRAMSKGMVGNTTRVALMKALKGRRDIDEILRFELKEVESNQVNADTGEVLMEISAECEREPLYRLWHIIYSISDKNEQKSALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKSGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYRKGNLTGDVTYVHKGQTHTEERIKDWSKRLDHRHHAIDALTIACTRQSIIQRLNTLNAKTAIGEEQMSLDKWTLAQAHFSVADVADHVADILVSFKSGKRVTTLGKRYVYKAGRRIVAQENILVPRGALSAESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKYIREVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTVIDKNVPEDLAGGLPSPEWTFVMSMQQNEMFVLGMGDDEFNDAFAGRDYKSLGEHLYRVQKLASLYYVFRSQYETKLDDSNNALAMRKFYRVRSFNALFSLNPRKVSISLLGEISLKDD

SEQ ID NO: 1112 - protein, 1221 aa, Unknown
  Description of Unknown: uncultivated organism with predicted taxonomy: Bacteroidales
  MG16-23 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKVLGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNRSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1113 - protein, 1221 aa, Unknown
  Description of Unknown: uncultivated organism with predicted taxonomy: Bacteroides sp. CAG:770
  MG16-24 effector
MKKVLGLDLGVSSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDYQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDTIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHALDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1114 - protein, 895 aa, Unknown
  Description of Unknown: uncultivated organism with predicted taxonomy: Bacteroides sp. CAG:770
  MG16-25 effector
MKKILGLDLGVGSVGWSVVSCDDEHKPVEILGMGSRIVPLTPDESNEFSSGNAASKNQSRTQKRTARKGYDRYQLRRQALTGKLRELGMLPDEALIKLPVMDLWTLRARAATPGEKLSLAEIGRVLYHLNQKRGYRHSKEDDSADKTQRDYVQAVNKRFQEIMNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNRKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIEEVLRFDLSAVESNQVNADTGEVLMEISAECEREPLYRLWHIIYSISDKNEQKSALKNQFGISDESMLESLCRIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIARRIEELGLVPSKNKILKYRLWEESVKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKKVATPGKRYVYKAGRRRVVQENILVPRGALSEESV

SEQ ID NO: 1115 - protein, 1071 aa, Unknown
  Description of Unknown: uncultivated organism with predicted taxonomy: Bacteroides
  MG16-26 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTY

SEQ ID NO: 1116 - protein, 1220 aa, Unknown
  Description of Unknown: uncultivated organism with predicted taxonomy: Bacteroides sp. CAG:770
  MG16-27 effector
MKKILGLDLGVGSVGWSVVSCDDEHKPVEILGMGSRIVPLTPAESNEFSSGNAASKNQSRTQKRTARKGYDRYQLRRQALTVKLRELGMLPDEALIKLPVLDLWTLRARAATPGEKLSLAEIGRVLYHLNQKRGYRHSKEDDSADKTQRDYVQAVNKRFQEIKNEGLTIGQHFAVKLKGSEVITDKGAFYNYRIKEQVFPRAAYVEEFDRIIQCQREFYPEVLTAADVNEIRNEIIYYQRPLKSCKHLVSSCEFMQRELFDAEHNPIRNRKGEIVVAGPKCAPKSSPLAQVCKIWEEINNIRVTNKENDEYFVGIDNKHEIFDFLNTHEKMKADDLFKILGLAKNSGWSADRAMSKGMVGNTTRVALMKALKGRRDIDDILRFDLREVESNQVNADTGEVLMEIGAECESEPLYRLWHIIYSISDKNEQKAALEKQFGITDESMLESLCRIDFVKQGYSSRSFKFMRKILPSLMDGAKYSEACDVIGINHSDSITKAENQTRKLLPKLPQLQKNELRQPVVEKILNQMINVVNAVIDKYGAIDEIRVEMARELKLSKAGRESAAKNIRTREKANEEIAKRIEELGLVPSKNKILKYRLWEESGKRCFYCGQPVSATEFLNGLDVEIEHIVPKSLLFDDSFSNKVCACRKCNAEKGNATAFDYMKGRGENAFEDYLKRVEAAFKENKISQTKRNRLLTPADKIPKDFISRQLVQTQYISRKAMEILDQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKKVTTPGKRYVYKAGSRRVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLDSIKAKDAASIVDKHIRDVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLTGGLPSPEWTFVMSMQQNEMFVLGMGDDEFNDALAGRDYKSLGEHLYRVQKLASSYYVFRSQYETKLDDSKNALMMKKYYRTQSFNALFAINPRKVSISLLGEISLKDD

SEQ ID NO: 1117 - protein, 1219 aa, Unknown
  Description of Unknown: uncultivated organism with predicted taxonomy: Bacteroides sp. CAG:545
  MG16-28 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDKIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLPRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHTLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPFEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYIDSDGMYHKSTLTFWKAVERKKYGLPVIIRKPWEIWDIIIDKNIPEELAAGLPAPDWKFVMSMQQNEMFILGMEDDEFRDAMEVKDYKTLGAHLYRVQKLEHLNFRIQYDTILDDSKAAKDMKKFYEIRSFKAFWALHPRKVSVSLLGEMALKDD

SEQ ID NO: 1118 - protein, 1221 aa, Unknown
  Description of Unknown: uncultivated organism with predicted taxonomy: Bacteroides sp. CAG:709
  MG16-29 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGISKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRKSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLMACDNDVNAACASLKKEPLYLDAEKTIPLEYGTCYKRKYVIKYPISSLKAKDVESIIDGHIRQIVSERLSEYGNDPKKAFAEPLYADDAKTIPVRTVRCYTGLDQVVPVKKDVAGNDIGFVKPGNNHHIAICRDADGKFHECVETFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRVRSFNALFYLHPRKVAVSLLGEMSLKND

SEQ ID NO: 1119 - protein, 1221 aa, Unknown
  Description of Unknown: uncultivated organism with predicted taxonomy: Bacteroides sp. CAG:709
  MG16-30 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1120 - protein, 1221 aa, Unknown
  Description of Unknown: uncultivated organism with predicted taxonomy: Bacteroides sp. CAG:709
  MG16-31 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVALSKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACYNDVNAACASLKKEPLYLDAEKTIPLEYGTCYKAKYVMKYALSALKPKDVEYIVDEHIRKVVSERLSEYGNDPKKAFAEPLYADDAKTIDVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1121 - protein, 1219 aa, Unknown
  Description of Unknown: uncultivated organism with predicted taxonomy: Alistipes sp. CAG:514
  MG16-32 effector
MKKVLGLDLGVGSVGWSLVNVDDNYKPAEILGLGSRIISLSPDESSEFTSGNAASKNQKRTQKRTARKGYDRYQMRRQALTEKLRELKMLPDERLIKLPVLDLWTLRARAATPGEKLTLPEIGRVLYHINQKRGYRHSKSDDSADKEQRDYVQTVNKRFQEIKDEGTTIGQHFAIILKESEVFTEKGPFYNYRIKEQVFPRDAYIEEFDRIMACQKAFYPEELSDININEIRNEIIFYQRNLRSCKHLVSRCEFMTRRFFDAEHKPILNNSGEIVISGPKVAPKSSPIFQACKIWEEINNLSLRNKENDELHISREQKKEIFEYLDNNEKITATALYKILGIGKGDGWSMDKALSKGVTGNTTKTAIARALGKMNNPAKESLLRFDLRLKENGVNKDSGEVIYEIDPECENEPLYRLWHIIYSINDKEALRQALTNQFGINDEESLKELSNIDFVKQGYGSRSAKFMRKLLPALIGGAKYSEACDMIGINHSGSLTKSENEARELLHKIPQLQKNELRQPVVEKILNQMINVVNAVIDQFGDIDEIRVEMARELKLSKEGRAATAKNIRDREKQNNEIAEKIKELGITPSKNKILKYRLWQESGQKCFYCGQPVGAAEFLNGLDVEIEHIVPKALLFDDSFSNKVCACRRCNAEKSNLTAYDYMKSKGENEFNDYLRRVDAAFNDHKISFTKRSRLLTPADKLPKDFILRQLVQTQYISRKAMEILKQVCHNVYGSSGEVTSYLRRIWGYDEILHSLDLPRYREGGMTTEVSYEHRGQTHTEERIKDWSKRLDHRHHAIDALTIACTRQSIIQRLNNLSSMTATAGESMSLDKWTSAQPHFSVQEVSDNVSRILVSFKAGKKVTTPGKRYIHRGGKRILTQEGLLIPRGALCEESVYGRILSLEKAVPVKKLFERVEDIVKPGIRAMVEERLQACNNDVKVACASLKKEPLYLDAEKTIPLEYGTCYKAEYVMKYTLSALKPKDVEYIVDEHIRKVVSERLSEYGNDPKKAFAEPLYADEAKTIPIRTVRCYTDLRQAAPVKKDANGNDIGFVKPGNNHHIAIYIDSDGVYHKSTITFWKAVERKKYGLPVIIRKPREIWMIIIDKNIPEELAAGLPDPDWKFVMSMQQNEMFVLGMEDDEFRDAMEGKDYKTLGAHLYRVQKLEHLNFRIQYDTILDDSKAAKDMKKFYEIRGFKAFWALHPRKVSVSLLGELSLKDD

SEQ ID NO: 1122 - protein, 1219 aa, Unknown; identical to SEQ ID NO: 1121
  Description of Unknown: uncultivated organism with predicted taxonomy: Alistipes sp. CAG:514
  MG16-33 effector

SEQ ID NO: 1123 - protein, 1221 aa, Unknown
  Description of Unknown: uncultivated organism with predicted taxonomy: Bacteroides sp. CAG:545
  MG16-34 effector
MKKVLGLDLGVGSVGWSLVNVDDNYKPMEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQSVNKRYQEIKDEGATIGQHFAIKLKESEIVTDKGPFYNYRIKEQVFPRDAYIEEFDRIMACQKTFYPEELSDGNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELSKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLMIPRGALCEESVYGRIHSLEKEVPVKKLFERVDDIVKPGIRTAVEERLRACDNDVKVACASLKKEPLYLDAEKTIPLEYGTCYKAEYAMRYALSALKPKDVEFIVDEHIRKVVSERLSEYGNDPKKAFAEPLYADKSKMIPIRTVRCYTGLAQVVPIKKDSNGNDIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEGKDYKTLGAHLYRVQKLTSLYYVFRHQYETQLDDSKGAQIMKKFYRVRSFNAMFALHPRKVSVSLLGEMALKDD

SEQ ID NO: 1124 - protein, 1186 aa, Unknown
  Description of Unknown: uncultivated organism with predicted taxonomy: Bacteroides sp. CAG:770
  MG16-35 effector
MGSRIVPLTPDESNEFSSGNAASKNQSRTQKRTARKGYDRYQLRRQALTGKLRELGMLPDEALIKLPVMDLWTLRARAATPGEKLSLAEIGRVLYHLNQKRGYRHSKEDDSADKTQRDYVQAVNKRYQEIKNEGLTIGQHFAVKLKESEVITDKGAFYNYRIKEQVFPRAAYVEEFDRIIQCQREFYPEVLTEANVNEIRNEIIYYQRLLKSCKHLVSVCEFMQRELFDAEHNPIRNRKGEIVIAGPKCAPKSSPLAQVCKIWEEVNNIRITNKENDEYFISVDDRHKIFDFLNTHEKMKADDLFKILGLAKNSGWSADRAMSKGMVGNTTRVALMKALKGRRDIEEVLRFDLSAVESNQVNADTGEVLMEISAECEREPLYRLWHIIYSISDKNEQKSALKNQFGISDESMLESLCRIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIACTRQSIIQKLNTLNAKTAIGEEQISLDKWTLAQAHFSVADVADHVADILVSFKSGKKVATPGKRYVYKAGRRSVAQENILVPRGALSEESVYGRIKSIEEKVPVKKLFERADDIVKPRIRHLIGERLEACGGDCSKAVSSLRKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGTYYWKLVTLWNAVDRKRYGLPIIVRNPYEISDIIIDSNIPDALASGLPEPNWSFVMSLQQNEMFVLGMSEEEFRCAIENKDYKTLGMHLYRVQKLSHLRFRSQYETRLDDSSEAKNMKKFYEIRSLKSFWSLNPRKVSISLLGEISLKDD

SEQ ID NO: 1125 - protein, 1221 aa, Unknown
  Description of Unknown: uncultivated organism with predicted taxonomy: Bacteroides
  MG16-36 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGSNHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDKILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQKGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYFVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1126 - protein, 1221 aa, Unknown
  Description of Unknown: uncultivated organism with predicted taxonomy: Bacteroides sp. CAG:545
  MG16-37 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIYYVFRHQYETQLDDSKGALVMKKFYRTASFKALFALHPRKVSVSLLGEMALKDD

SEQ ID NO: 1127 - protein, 1221 aa, Unknown; identical to SEQ ID NO: 1125
  Description of Unknown: uncultivated organism with predicted taxonomy: Bacteroides
  MG16-38 effector

SEQ ID NO: 1128 - protein, 1220 aa, Unknown
  Description of Unknown: uncultivated organism with predicted taxonomy: Bacteroides sp. CAG:770
  MG16-39 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEIGAECESEPLYRLWHIIYSISDKNEQKAALEKQFGITDKSMLESLCRIDFVKQGYSSRSFKFMRKILPSLMDGAKYSEACDVIGINHSDSITKAENQTRKLLTKLPQLQKNELRQPVVEKILNQMINVVNAVIDKYGAIYEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKRVTTPGKRYVYKAGRRIVAQENILVPRGALSEESVYGRIKSIEEKVPVKKLFERADDIVKPRIRRLIRERLETFGGDCSKAVSSLKKSPLYLDEENTIMLEYGSCFKPEYVIKYSLNSIKAKDAVSIVDKHIREVVTARLAAFGDDPKKAFAEPLYSYASGKIQIKTVRCYTGLSQVVPVKRDADGNDIGFVKPGNNHHIAIYKDADGKYQESIVTFCDAVERKKYGIPVVVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 1129 - protein, 1221 aa, Unknown
  Description of Unknown: uncultivated organism with predicted taxonomy: Bacteroides sp. CAG:770
  MG16-40 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGRHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKVVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSIIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLKACDNDVNAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKRDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFMDAMAEADYKALGAHLYRVQKLASSYYVFRHQYETQLDDSKCAQIMKKFYRAQSFKALFALHPRKVSVSLLGEMALKDD

SEQ ID NO: 1130 - protein, 1220 aa, Unknown
  Description of Unknown: uncultivated organism with predicted taxonomy: Bacteroides sp. CAG:770
  MG16-42 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVQDLWTLRARAATLGNKLSLPEIGRVLYHLNQKRGYRHSKQDDSADKTQRDYVQAVNKRFQEIKDEGLTIGQHFAVKLKESEVITDKGAFYNYRIKEQVFPRAAYVEEFDRIIQCQREFYPEVLTEANVNEIRNEIIYYQRPLKSCKHLVSSCEFMQRELFDAEHNPIRNRKGEIVVAGPKCAPKSSPLAQVCKIWEEINNIRVTNKENDEYFISIDNKHEIFDFLNTHEKMKADDLFKILGIAKNSGWSADKAMSKGMVGNTTRVALMKALKGRRDIDEILRFDLREVESNQVNADTGEVLMEIGAECESEPLYRLWHIIYSISDKNEQKAALEKQFGITDESMLESLCRIDFVKQGYSGRSFKFMRKILPSLMDGAKYSEACDVIGINHSDSITKAENQTRKLLTKLPQLQKNELRQPVVEKILNQMINVVNAVIGKYGAIDEIRVEMARELKLSKEGRESAAKNIRAREKANEEIAKRIEELGLLPSKNKILKYRLWEESGKRCFYCGQPVSATEFLNGLDVEIEHVVPKSLLFDDSFSNKVCACRKCNAEKGNATAFDFMNGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHMGQTHTEERIKDWSKRLDHRHHAIDALTIACTRQSIIQRLNTLNAKTAIGEEQMSLDKWTLAQAHFSVADVSDHVADILVSFKSGKKVTTPGKRCVYKAGRRIVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDAASIVDKHIRDVVIARFAAFGDDPKKAFAEPLYADEAGKIQIKTVRCYTGLSQVVPVKKDAAGNDIGFVKPGNNHHIAIYKDADGKYQESIVTFRDAVERKKYGIPVVVRNPVEVLDTVIDKNVPEDLAGGLPSPEWTFVMSMQQNEMFVLGMGDDEFNDALAGRDYKSLGEHLYRVQKLATSDYFFRSQYETKLDDSKGASAMRKFYRTASLKALFALNPRKVSISLLGEISLKDD

SEQ ID NO: 1131 - protein, 1220 aa, Unknown; identical to SEQ ID NO: 1130
  Description of Unknown: uncultivated organism with predicted taxonomy: Bacteroides sp. CAG:770
  MG16-43 effector

SEQ ID NO: 1132 - protein, 1232 aa, Unknown
  Description of Unknown: uncultivated organism with predicted taxonomy: Bacteroides sp. CAG:770
  MG16-44 effector
CGSYRSGLSDRAYISRVHLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDAEHNPIRNGKGEIIVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEISAECESEPLYRLWHIIYSISDKNEQKSALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKSGRESAAKNIRTREKANEEIAKRIEELGLVPSKNKILKYRLWEESGKRCFYCGQPVSATEFLNGLDVEIEHVVPKSLLFDNSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHYLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDAVSIVDNHIREVVTARLAAFGDDPKKSFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDAMVGMDYKSLGEHLYRVQKLASLYYVFRSQYETKLDDSNNALAMRKFYRVRSFNALFSLNPRKVSISLLGEISLKDD

SEQ ID NO: 1133 - protein, 1186 aa, Unknown; identical to SEQ ID NO: 1124
  Description of Unknown: uncultivated organism with predicted taxonomy: Bacteroides sp. CAG:770
  MG16-45 effector

SEQ ID NO: 1134 - protein, 1221 aa, Unknown
  Description of Unknown: uncultivated organism with predicted taxonomy: Bacteroides sp. CAG:770
  MG16-46 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGDSLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNLRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTTVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSLYYVFRHQYETQLDDSKGAQIMKKFYRVRSFNAMFALHPRKVSVSLLGEMALKDD

SEQ ID NO: 1135 - protein, 1221 aa, Unknown
  Description of Unknown: uncultivated organism with predicted taxonomy: Bacteroides sp. CAG:709
  MG16-47 effector
MKKILGLDLGVGSIGWSLINADKDNKPIAILGLGSRIISLSPDESSEFTSGNAASKNQKRTQKRTTRKGYDRYQMRRQALTDKLSKLKMLPDEHLIKLPVLDLWTLRARAATPGEKLTLQEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRTLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGIGKSDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHRISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAEYVMKYALSALKPKDVEYIVDEHIRKVVSERLSEYGNDPKKAFAEPLYADDAETIPVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRIQSFKALFALHPRKVAVSLLGEMSLKND

SEQ ID NO: 1136 - protein, 1220 aa, Unknown
  Description of Unknown: uncultivated organism with predicted taxonomy: Bacteroides sp. CAG:770
  MG16-48 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKCFQEIKDEGLTIGQHFAVKLKESEVITDKGAFYNYRIKEQVFPRAAYVEEFDRIIQCQREFYPDVFTEAIVNEIRNEIIYYQRPLKSCKHLVSVCEFMQRELFDAGHNPIRHRKGEIVVAGPKCAPKSSPLAQVCKIWEEVNNIRITNKENDEYFISIDNKHEIFDFLNTHEKMKADDLFKILGIAKNSGWSADRAMSKGMVGNTTRVALMKALKGRRDIDDILRFDLREVESNQVNADTGEVLMEISAECESEPLYRLWHIIYSISDKNEQKSALKNQFGISDDSMLESLCKIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNAKTAIGEEQISLDKWTLAQAHFSVADVADHVADILVSFKSGKKVTTPGKRYVYRAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKHVREVVTARLAAFGDEPKKAFAEPLYADVAGKIQIKTVRCYTGLSQVVPVKKDADGNDIGFVKPGNNHHIAIYKDADGKYQESIVTFCDAVERKKYGIPVVVRNPAAVLDTVIDKNVPEDLARGLPSPEWTFVMSMQQNEMFVLGMGDDEFNDAMAEMDYKSLGEHLYRVQKLTSSYYVFRSQYETKLDDSKNALRMKKYYRTQSFNALFSLNPRKVSISLLGEISLKDD

SEQ ID NO: 1137 - protein, 1191 aa, Unknown
  Description of Unknown: uncultivated organism with predicted taxonomy: Bacteroides sp. CAG:770
  MG16-50 effector
ILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKCFQEIKDEGLTIGQHFAVKLKESEVITDKGAFYNYRIKEQVFPRAAYVEEFDRIIQCQREFYPDVFTEAIVNEIRNEIIYYQRPLKSCKHLVSVCEFMQRELFDAGHNPIRHRKGEIVVAGPKCAPKSSPLAQVCKIWEEVNNIRITNKENDEYFISIDNKHEIFDFLNTHEKMKADDLFKILGIAKNSGWSADRAMSKGMVGNTTRVALMKALKGRRDIDDILRFDLREVESNQVNADTGEVLMEISAECESEPLYRLWHIIYSISDKNEQKSALKNQFGISDDSMLESLCKIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNAKTAIGEEQISLDKWTLAQAHFSVADVADHVADILVSFKSGKKVTTPGKRYVYRAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKHVREVVTARLAAFGDEPKKAFAEPLYADVAGKIQIKTVRCYTGLSQVVPVKKDADGNDIGFVKPGNNHHIAIYKDADGKYQESIVTFCDAVERKKYGIPVVVRNPAAVLDTVIDKNVPEDLARGLPSPEWTFVMSMQQNEMFVLGMGDDEFNDAMAEMDYKSLGEHLYRVQKLTSSYYVFRSQYETKLDDSKNALRMKKYYRTQSFNALFSLNPRKVSISLLGEISLKDD

SEQ ID NO: 1138 - protein, 1220 aa, Unknown; identical to SEQ ID NO: 1136
  Description of Unknown: uncultivated organism with predicted taxonomy: Bacteroides sp. CAG:770
  MG16-51 effector

SEQ ID NO: 1139 - protein, 1217 aa, Unknown
  Description of Unknown: uncultivated organism with predicted taxonomy: Bacteroides sp. CAG:770
  MG16-52 effector
MKKILGLDLGVGSVGWSVVSCDDEHKPVEILGMGSRIVPLTPDESNEFSSGNAASKNQSRTQKRTARKGYDRYQLRRQALTVKLRELGMLPDETLIKLPVLDLWTLRARAATPGDKLSLPEIGRVLYHLNQKRGYRHSKQDDSADKTQRDYVQAVNKRFQEIKDEGLTIGQHFAVKLKESELITDKGAFYNYRIKEQVFPRAAYVEEFDRIIQCQREFYPEVFTEAIVNEIRNEIIYYQRPLKSCKHLVSVCEFMQRELFDAGHNPIRNRKGEIVVAGPKCAPKSSPLAQVCKIWEEINNIRVTNKENDEYFISIDNKHEIFDFLNTHEKMKADDLFKILGIAKNSGWSADRAMSKGMVGNTTRVALMKALKGRRDIDDILRFDLREVESNQVNADTGEVLMEIGAECESEPLYRLWHIIYSISDKNEQKAALEKQFGITDKSMLESLCRIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKAGRRIVAQENILVPRGALSEESVYGRIKSIEEKVPVKKLFERVDDIVKPRIRRLIRDRLKACGGDCSKAVSSLKKSPLYLDEENTIMLEYGSCFKPEYVIKYSLNSIKAKDAVSIVDNHVREVVTERLAAFGDDPKKAFAEPLYADAAGKIQIRTVRCYTNSTVVPVKKDADGNDIGFVKPGNNHHIAIYKDADGTYYWKLVTLWNAVDRKRYGLPIIVRNPYEISDIIIDSNIPDALASGLPEPNWSFVMSLQQNEMFVLGMSEEEFRCAIENKDYKTLGMHLYRVQKLSHLRFRSQYETRLDDSSEAKNMKKFYEIRSLKSFWSLNPRKVSISLLGEISLKDD

SEQ ID NO: 1140 - protein, 1221 aa, Unknown
  Description of Unknown: uncultivated organism with predicted taxonomy: Bacteroides sp. CAG:709
  MG16-53 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKKDVAGNDIGFVKPGNNHHIAIYRDADGKFHECVVTFWDAVERKKYGMPVIVRNPDEVWDDVIDKNVPEELAAGLPALGWSFVMSLQQNEMFILGMEDDEFRDAMAEADYKALGAHLYRVQKLAGSDYYFRSHYETLLDDSAGARIMKKFYRIQSFKALFALHPRKVAVSLLGEMSLKND

SEQ ID NO: 1141 - protein, 1221 aa, Unknown
  Description of Unknown: uncultivated organism with predicted taxonomy: Bacteroides sp. CAG:709
  MG16-54 effector
MKKILGLDLGVGSIGWSLINADKDNKPIAILGLGSRIISLSPDESSEFTSGNAASKNQKRTQKRTARKGYDRYQMRRSALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRIMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGISKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLMACDNDVNAACASLKKEPLYLDAEKTIPLEYGTCYKRKYVIKYPISSLKAKDVESIIDGHIRQIVSERLSEYGNDPKKAFAEPLYADDAKTIPVRTVRCYTGLDQVVPVKKDVAGNDIGFVKPGNNHHIAIYRDADGKFHECVETFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1142 - protein, 1220 aa, Unknown
  Description of Unknown: uncultivated organism with predicted taxonomy: Bacteroides sp. CAG:770
  MG16-55 effector
MKKILGLDLGVGSVGWSVISCDDEHRPLEILGMGSRIVPLTPDESNEFSSGNAASKNQSRTQKRTARKGYDRYQSRRKALTDKLRDLDMLPDETLIKLPVLDLWTLRARAATPGDKLSLPEIGRVLYHLNQKRGYRHSKQDDSADKTQRDYVQAVNKRFQDIKDEGLTIGQHFAEKLKESEIITDKGAFYNYRIKEQVFPRAAYVEEFDRIIQCQRGFYPEVLTEANVNEIRNEIIYYQRPLKSCKHLVSVCEFMQRELFDADHNPIRNGKGEIVVAGPKCAPKSSPLAQVCKIWEEINNIRVTNKENDEYFISIDNKHEIFDFLNTHEKMKADDLFKILGLAKNSGWSADRAMSKGMVGNTTRVALMKALKGRRDIEEVLRFDLRAVESNQVNADTGEVLMEISAECEREPLYRLWHIIYSISDKNEQKSALKNQFGISDESMLESLYKIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSATEFLNGLDVEIEHVIPKSLLFDDSFSNKVCACRKCNAEKGNATAFDFMKGRGENAFEDYLKRVETAFKENRISQTKRSRLLTPADKIPKDFISRQLVQTQYISRKAMDILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKAAIGEEQMSLDKWTLAQAHFSVADVADHVADILVSFKSGKKVATPGKRYVYRAGSRNVAQENILVPRGALSEESVYGRIKSIEEKVPVKKLFERVDDIVKPRISHLICERLEACGGDCSKAVSSLKKSPLYLDEENTIMLEYGSCFKPEYVIKYSLNSIKAKDAVSIVDNHVREVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEELARGLPSPEWTFVMSMQQNEMFVLGMGDDEFNDAMAGRDYKSLGEHLYRVQKLATSDYFFRSQYETKLDDTKNALSMKKYYRTRSFKALFALNPHKVSISLLGEISLKDD

SEQ ID NO: 1143 - protein, 1219 aa, Unknown
  Description of Unknown: uncultivated organism with predicted taxonomy: Bacteroides sp. CAG:545
  MG16-56 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAMGKALGKEHNTKKSDLLRFDLRLKENGVNKDTGEIIYEIDPACENEPLYRLWHVIYSINDKDALRHALTNQFGINDGESLRKLTKIDFVKQGYGSRSAKFMRKLLPALMDGARYSEACDMIGINHSDSLTKSENEARELLHKIPQLQKNELRQPVVEKILNQMINVVNAVIEQFGSIDEIRVEMARKLKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPFEYGTCYKAEYVMRYALSALKPKDVEFIVDEHIRKVVSERLSEYGNDPKKAFAEPLYADKSKTIPIRALRCYTGLAQVVPVKKDSKGNDIGFVKPGNNHHIAIYIDSDGMYHKSTLTFWKAVERKKYGLPVIIRKPWEIWDIIIDKNIPEELAAGLPAPDWKFVMSMQQNEMFILGMEDDEFRDAMEVKDYKTLGAHLYRVQKLEHLNFRIQYDTILDDSKAAKDMKKFYEIRSFKAFWALHPRKVSVSLLGEMALKDD

SEQ ID NO: 1144 - protein, 1220 aa, Unknown; identical to SEQ ID NO: 1108
  Description of Unknown: uncultivated organism with predicted taxonomy: Bacteroides sp. CAG:770
  MG16-57 effector

SEQ ID NO: 1145 - protein, 1223 aa, Unknown
  Description of Unknown: uncultivated organism with predicted taxonomy: Bacteroides sp. CAG:770
  MG16-58 effector
MKKILGLDLGVGSVGWSVISCDDEHRPREILGMGSRIVPLTPDESNEFSSGNAASKNQSRTQKRTARKGYDRYQSRRKALTDKLRELDMLPDEALIKLPVLDLWTLRARAATPGDKLSLPEIGRVLYHLNQKRGYRHSKQDDSADKTQRDYVQAVNKRFQEIKDEGLTIGQHFAEKLKDSEIITDKGAFYNYRIKEQVFPRAAYVEEFDRIIQCQREFYPEVLTEANVNEIRNEIIYYQRPLKSCKHLVSVCDFMQRELFDADHNPIRNGKGKIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVGSNQVNADTGEVLMEISAECEREPLYRLWHIIYSISDKNEQKSALKNQFGISDDSMLESLCKIDFVKQGYSSRSFKFMRKILPSLMDGAKYSEACDVIGINHSDSITKAENQARELLTRLPQLQKNELRQPVVEKILNQMINVVNAVIDKYGAIDEIRVEMARELKLSKAGRESAAKNIRTREKANEEIAKRIEELDLVPSKNKILKYRLWEESGKRCFYCGQPVSATEFLNGLDVEIEHIVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVAGILVSFKSGKRVTTPGKRYVYKTGRRIVAQENILVPRGALSEESVYGRIKSIEEKVPVKKLFERVDDIVKPRIRYLIRERLETFGGDCSKAVSSLKKSPLYLDEENTIMLEYGSCFKYSYVKKSKLIQLDKKDDFINVSLIVDKHIREVVTARLAAFGGDTKKAFAEPLYADEAGKIQIRTVRCYTNSTVVTVKKDADGNDIGFVKPGNNHHIAIYKDADGKYQESIVTFCDAVERKKYGIPVVVRKPAAVLDTVIDKNVPEDLARGLPSPEWTFVMSMQQNEMFVLGMGDDEFNDALAGRDYKSLGEHLYRVQKLASLYYVFRSQYETKLDDSNNALAMRKFYRVRSFNALFSLNPRKVSISLLGEISLKDD

SEQ ID NO: 1146 - protein, 1221 aa, Unknown
  Description of Unknown: uncultivated organism with predicted taxonomy: Bacteroides sp. CAG:770
  MG16-59 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISLEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNNTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLEHRHHAIDALTIACTRQSIIQRLNNLSAMTAVAGESMSLDKWTLAQPHFSVQEVSDNVSRILVSFKAGKKVTTPGKRYVYRGGKRVLAQESLLIPRGALCEESVYGRIHSLEKEVPVKKLFERVDDIVRPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVMCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLASIYYVFRHQYETQLDDSKGAQIMKKFYRAQSFKALFALHQRKVSVSLLGEMALKDD

SEQ ID NO: 1147 - protein, 1221 aa, Unknown
  Description of Unknown: uncultivated organism with predicted taxonomy: Bacteroides sp. CAG:770
  MG16-60 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGSNHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQKGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYFVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNISEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1148 - protein, 1221 aa, Unknown
  Description of Unknown: uncultivated organism with predicted taxonomy: Bacteroides sp. CAG:709
  MG16-61 effector
MKKILGLDLGVGSIGWSLINADKDNKPIAILGLGSRIISLSPDESSEFTSGNAASKNQKRTQKRTTRKGYDRYQMRRQALTDKLSKLKMLPDEHLIKLPVLDLWTLRARAATPGEKLTLQEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRDLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLEVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKEEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFIFGMEDDEFMDAMAEADYKALGAHLYRVQKLAGSDYYFRSHYETLLDDSAGARIMKKFYRISSSKALFALHPRKVAVSLLGEMSLKND

SEQ ID NO: 1149 - protein, 1221 aa, Unknown
  Description of Unknown: uncultivated organism with predicted taxonomy: Bacteroides sp. CAG:770
  MG16-62 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGDSLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKLGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIYYVFRHQYETQLDDSKGALVMKKFYRTASFKALFALHPRKVSVSLLGEMALKDD

SEQ ID NO: 1150 - protein, 1221 aa, Unknown
  Description of Unknown: uncultivated organism with predicted taxonomy: Bacteroides sp. CAG:770
  MG16-63 effector
MKKVLGLDLGVGSVGWSLVNVDDNYKPTEILGIGSRIISLSPDESSEFTSGNAASKNQKRRQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKGALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1151 - protein, 1219 aa, Unknown
  Description of Unknown: uncultivated organism with predicted taxonomy: Alistipes sp. CAG:514
  MG16-64 effector
MKKVLGLDLGVGSVGWSLVNVDDNYKPAEILGLGSRIISLSPDESSEFTSGNAASKNQKRTQKRTARKGYDRYQMRRQALTEKLRELKMLPDERLIKLPVLDLWTLRARAATPGEKLTLPEIGRVLYHINQKRGYRHSKSDDSADKEQRDYVQTVNKRFQEIKDEGTTIGQHFAIILKESEVFTEKGPFYNYRIKEQVFPRDAYIEEFDRIMACQKAFYPEELSDININEIRNEIIFYQRNLRSCKHLVSRCEFMTRRFFDAEHKPILNNSGEIVISGPKVAPKSSPIFQACKIWEEINNLSLRNKENDELHISREQKKEIFEYLDNNEKITATALYKILGIGKGDGWSMDKALSKGVTGNTTKTAIARALGKMNNPAKESLLRFDLRLKENGVNKDSGEVIYEIDPKCENEPLYRLWHIIYSINDKEALRQALTNQFGINDEESLKELSNIDFVKQGYGSRSAKFMRKLLPALIGGAKYSEACDMIGINHSGSLTKSENEARELLHKIPQLQKNELRQPVVEKILNQMINVVNAVIDQFGDIDEIRVEMARELKLSKEGRAATAKNIRDREKQNNEIAEKIKELGITPSKNKILKYRLWQESGQKCFYCGQPVGAAEFLNGLDVEIEHIVPKALLFDDSFSNKVCACRRCNAEKSNLTAYDYMKSKGENEFNDYLRRVDAAFNDHKISFTKRSRLLTPADKLPKDFILRQLVQTQYISRKAMEILKQVCHNVYGSSGEVTSYLRRIWGYDEILHSLDLPRYREGGMTTEVSYEHRGQTHTEERIKDWSKRLDHRHHAIDALTIACTRQSIIQRLNNLSSMTATAGESMSLDKWTSAQPHFSVQEVSDNVSRILVSFKAGKKVTTPGKRYIHRGGKRILTQEGLLIPRGALCEESVYGRILSLEKAVPVKKLFERVEDIVKPGIRAMVEERLQACNNDVKVACASLKKEPLYLDAEKTIPLEYGTCYKAEYVMKYTLSALKPKDVEYIVDEHIRKVVSERLSEYGNDPKKAFAEPLYADEAKTIPIRTVRCYTDLRQVAPVKKDANGNDIGFVKPGNNHHIAIYIDSDGVYHKSTITFWKAVERKKYGLPVIIRKPREIWMIIIDKNIPEELAAGLPDPDWKFVMSMQQNEMFVLGMEDDEFRDAMEGKDYKTLGAHLYRVQKLEHLNFRIQYDTILDDSKAAKDMKKFYEIRGFKAFWALHPRKVSVSLLGELSLKDD

SEQ ID NO: 1152 - protein, 1220 aa, Unknown
  Description of Unknown: uncultivated organism with predicted taxonomy: Bacteroides sp. CAG:770
  MG16-65 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDAVGINHSDSITKAKNQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKKVTTPGKRYVYKAGRRRVAQENILVPRGALSEESVYGRIKSIEEKVPVKKLFERVDDIVKPRIRHLVRERLEACGGDCSKAVSSLKKSPLYLDEENTIMLEYGSCFKPEYVIKYSLNSIKAKDAVSIVDKHVREVVTARLAAFGDDPKKAFAEPLYADEAGKIQIKTVRCYTGLSQVVPVKKDADGNDIGFVKPGNNHHIAIYKDAGGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISLLGEISLKDD

SEQ ID NO: 1153 - protein, 1221 aa, Unknown
  Description of Unknown: uncultivated organism with predicted taxonomy: Bacteroides sp. CAG:770
  MG16-66 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNAHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGEYMSLDKWTLAQPHFSVQEVSDNVSRILVSFKAGKKVTTPGKRYVYRGGKRILAQEGLLIPRGALCEESVYGRIHSLEKEVPVKKLFERVDDIVRPGIRAAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRNVEGTYHESIVTFWDSVERKKYGLPVIIRKPGEIWDILIDKNIPEELAAGLPAPDWQFVMSMQQNEMFVLGMEDDEFRDAMEVKNYKTLGAHLYRVQKLASIDYYFRSQYETALDNSAGARMMKKFYRINSIKSLFALHPRKVSVSLLGEMALKDD

SEQ ID NO: 1154 - protein, 1221 aa, Unknown
  Description of Unknown: uncultivated organism with predicted taxonomy: Bacteroides sp. CAG:545
  MG16-67 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEGNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAMAKALGKEHNTKKSDLLRFDLRLKENGVNKDTGEIIYEIDPACENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAERTYHENIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1155 - protein, 1221 aa, Unknown; identical to SEQ ID NO: 1109
  Description of Unknown: uncultivated organism with predicted taxonomy: Bacteroides sp. CAG:770
  MG16-68 effector

SEQ ID NO: 1156 - protein, 1221 aa, Unknown; identical to SEQ ID NO: 1120
  Description of Unknown: uncultivated organism with predicted taxonomy: Bacteroides sp. CAG:709
  MG16-69 effector

SEQ ID NO: 1157 - protein, 1221 aa, Unknown
  Description of Unknown: uncultivated organism with predicted taxonomy: Bacteroides sp. CAG:770
  MG16-70 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKVLSKGFTGNTTKGAIAKALGKDHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGVNHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYDTCYKAKYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALNDD

SEQ ID NO: 1158 - protein, 1219 aa, Unknown; identical to SEQ ID NO: 1117
  Description of Unknown: uncultivated organism with predicted taxonomy: Bacteroides sp. CAG:545
  MG16-72 effector

SEQ ID NO: 1159 - protein, 1221 aa, Unknown
  Description of Unknown: uncultivated organism with predicted taxonomy: Bacteroides sp. CAG:545
  MG16-73 effector
MKKVLCLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEVGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLSLKENGVNKDTGEIIYEIDPACENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNIPEELAAGLPAPDWQFVMSMQQNEMFVLGMKDDEFRDAMEVKDYKTLGAHLYRVQKLTSIYYVFRHQYETQLDDSKGAQIMKKFYRAQSFKALFALHPRKVSVSLLGEMALKDD

SEQ ID NO: 1160 - protein, 1220 aa, Unknown
  Description of Unknown: uncultivated organism with predicted taxonomy: Bacteroides sp. CAG:770
  MG16-74 effector
MKKILGLDLGVGSVGWSVISCDDEHRPLEILGMGSRIVPLTPDESNEFSSGNAASKNQSRTQKRTARKGYDRYQSRRKALTDKLRDLDMLPDETLIKLPVLDLWTLRARAATPGDKLSLPEIGRGLYHLNQKRGYRHSKEDDSADKTQRDYVQAVNKRFQEIKDEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEKVNNIRITNKENDEYFISIDNKHEIFDFLNTHEKMKADDLFKILGIAKNSSWSADRAMSKGMVGNTTRVALMKALKGRRDIDEILRFDLREVESSQVNADTGEVLMEISAECEREPLYRLWHIIYSISDKNEQKSALKNQFGISDDSMLESLCKIDFVKQGYSSRSFKFMRRILPSLMDGAKYSEACDVIGINHSDSITKAENQARELLTRLPQLQKNELRQPVVEKILNQMINVVNAVIDKYGSIDEIRVEMARELKLSKAGRESAAKNIRTREKANEEIAKRIEELGLVPSKNKILKYRLWEESGKRCFYCGQPVSATEFLNGLDVEIEHIVPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNANTAIGEEQISLDKWTLAQAHFSVADVADHVADILVSFKSGKKVATPGKRYVYRAGRRIVAQENILVPRGALSEESVYGRIKSIEEKVPVKKLFERADDIVKPRIRHLIGARLEACGGDCSKAVSSLRKSPLYLDEEKTIMLEYGSCFKPEYVIKYSLNSIKAKDAVSIVDNHVREVVTARLAAFGDDPKKAFAEPLYADEAGKIQIKTVRCYTGLSQVVPVKKDADGNDIGFVKPGNNHHIAIYKNADGKYQESIVTFCDAVERKKYGIPVVVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 1161 - protein, 1221 aa, Unknown; identical to SEQ ID NO: 1119
  Description of Unknown: uncultivated organism with predicted taxonomy: Bacteroides sp. CAG:709
  MG16-75 effector

SEQ ID NO: 1162 - protein, 1219 aa, Unknown
  Description of Unknown: uncultivated organism with predicted taxonomy: Bacteroides
  MG16-76 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1163 - protein, 1220 aa, Unknown
  Description of Unknown: uncultivated organism with predicted taxonomy: Bacteroides sp. CAG:770
  MG16-77 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKEDDFADKTQRDYVQAVNKRFQEIKNEGLTIGQHFAVKLKESEVITDNGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPSLMDSAKYSEACDVIGINHSDSITKAENQTRKLLTKLPQLQKNELRQPVVEKILNQMINVVNAVIDKYGSIDEIRVEMARELKLSKAGRESAAKNIRTREKANEEIAKRIEELGLVPSKNKILKYRLWEESGKRCFYCGQPVSAAEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKRVTTPGKRYVYKAGRRIVVQENILVPRGALSEESVYGRIKSIEEKVPVKKLFERVDDIVKPRIRRLIRERLEACGGDCSKAVSSLKKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDALAGRDYKSLGEHLYRVQKLASLYYVFRSQYETKLDDSKGALTMKKFYRTASFKALFSLNPRKVSISLLGEISLKDD

SEQ ID NO: 1164 - protein, 1221 aa, Unknown
  Description of Unknown: uncultivated organism with predicted taxonomy: Bacteroides
  MG16-78 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSLLDAEHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKVLGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRSVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1165 - protein, 1221 aa, Unknown
  Description of Unknown: uncultivated organism with predicted taxonomy: Bacteroides sp. CAG:770
  MG16-79 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHRISFIKRSRLLTPADKLPKDFISRQLIQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNAIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIYYVFRHQYETQLDDSKGAQIMKKFYRAQSFKALFALHPRKVSVSLLGEMALKDD

SEQ ID NO: 1166 - protein, 1221 aa, Unknown; identical to SEQ ID NO: 1134
  Description of Unknown: uncultivated organism with predicted taxonomy: Bacteroides sp. CAG:545
  MG16-80 effector

SEQ ID NO: 1167 - protein, 1221 aa, Unknown
  Description of Unknown: uncultivated organism with predicted taxonomy: Bacteroides
  MG16-81 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDVILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADKSKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRVRSFNALFNLHPRKVAVSLLGEMSLKND

SEQ ID NO: 1168 - protein, 1221 aa, Unknown
  Description of Unknown: uncultivated organism with predicted taxonomy: Bacteroides sp. CAG:770
  MG16-82 effector
MKKVLGLDLGVGSVGWSLVNVDDNYKPTEILGIGSRIISLSPDESSEFTSGNAASKNQKRTQKRTARKGYDRYQMRRQALTEKLRELKMLPDEHLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKRDIFEYLDNNEKINATALYKILDIGKCDGWSVDKALSKGFTGNTTKVAIAKVLGKEHNTKKSDLLRFDLRLKENGVNKDTGEIIYEIDPTCENEPLYRLWHVIYSINDKDALRQALTNQFGINDGESLRELTKIDFVKQGYGSRSAKFMRKLLPALMDGARYSEACDMIGINHSGSLTKSENEARELLHTIPQLQKNELRQPVVEKILNQMINVVNAVIDQFGSIDEIRVEMARELKLSKEGRAATAKNIRDREKMNNEMAEKIKELGITPSKNKLLKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMSAVAGESMSLDKWTLAQPHFSVQEVSDNVSRILVSFKAGKKVATPGKRYVYRGSKRILAQEGLLIPRGALCEESVYGRINSLEKGVPVKKLFERVDDIVKPGIRTAVEERLRACDNDVKVACASLKKEPLYLDVEKTIPLEYGTCYKAEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFLDSVERKKYGLPVIIRKPGEIWDILIDKNIPEELAAGLPAPDWQFVMSMQQNEMFVLGMEDDEFMDAMEVKDYKTLGAHLYRVQKLTSIYYVFRHQYETQLDDSKGAQIMKKFYRAQSFKALFALHPRKVSVSLLGEMALKDD

SEQ ID NO: 1169 - protein, 1221 aa, Unknown
  Description of Unknown: uncultivated organism with predicted taxonomy: Bacteroides sp. CAG:545
  MG16-83 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGDSLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERIDDIVKPGIRAAVEERLRACDNDVKVACASLKKEPLYLDVEKTIPLEYGTCYKAKYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIDYYFRSQYETALDNSAGARMMKKFYRINSIKSLFTLHPRKVSVSLLGEMALKDD

SEQ ID NO: 1170 - protein, 1165 aa, Unknown
  Description of Unknown: uncultivated organism with predicted taxonomy: Bacteroidetes
  MG16-84 effector
MQTRKILGLDLGVGSVGWALIETEDDQPKSILAMGSRIVPLSSDDSTKFQKGQAITKNAERTQKRTMRKGLNRYQIRRALLTDLLRRNGMLPEYMNENVIDLWQLRSDAATEGKQLSLPQIGRVLYHINQKRGYKHSKADISADAKQTKYVEAVNQRYRNIQALHQTIGQYFCQQLKETAVQTEKGVYYTFRIKEKVLPRASYVAEFDQIMKVQQSYYPNVLTDELIDTLRNHIIFYQRPLKSCKHLVGLCEFEMRPYKRNDGQIVYGGPKCAPRTSPLAQLCAVWEAVNNITLTNRSNETLEITPKQRKAMADFLYEHEKMGVKDLQKILGISPKDGWWAGKAIGKGIKGNTTYTQLRDALGPISNAADLLSMKIELTDSMVDTTTAELIRQVSPNVEEQPLYRLWHIVYSAQNEDDLRKALHKQFDIEDEKVVANLGKIDFVKPGYANKSNKFMRKLLPYLMQGYKYNEACAHIGVNHSNSLTAEQNTVRPLLDKIPLLEKNALRQPVIEKILNQMINVVNALKAEFGDIDDVRIELARELKESKDERESAFKRNNENERKNKEYEARIREYGIRPSRSRIQKYKMWEESQKKCFYCGKTIDVVEFLNGVDAEIEHIIPQSVLFDDSFSNKVCSCRDCNHTKGNLTAREFMEQHSAADYEAYLRRVDEAFDEHRISKTKRDHLLWRKEDIPQDFIDRQLRQSQYIAKKAAEILRQGVRNVYATSGSVTDFLRHQWGYDNILHYLNLPRYQQVDGLTESVTYDHCGQKHQEERIKDWTKRLDHRHHAIDALTIALTQQSVIQRLNTLNASREEMKNDLGQRIDTPEYTEKRSLLEKWVDIQPHFSVQEVTDKVDGILISFRAGKRVATPAKRAIYQQRKRCIVQTGLQVPRGALSEETVYGKLGNKYVVKYALTHPSMKVDDIVDPTIREIVRNRLNAFGGNVKDAFAESLYSDVAHKMQIKSVRCYTNLQDKAVSAVRFNAQGEPVGFVKMGNNHHIAIYCDKKGQYQESVVSFWHAVERKRYGIPVVIEKPQEVWDKLIDIDAIPQDFLENLPKDDWQFVVSLQQNEMFILGMDEADYEAAMEQKDYRTLNKYLYRVQKISSKEYYFRYHTETSVDDKYEGKNNPNISIELQKLKRIKSFGALFSQHPHKVRINLLGEISAL

SEQ ID NO: 1171 - protein, 1221 aa, Unknown
  Description of Unknown: uncultivated organism with predicted taxonomy: Bacteroides
  MG16-85 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKGYKTLGAHLYRVQNISSLYYVLRLQYETQVDNSNEALNMKKFHRIRSFNALFALRPRKVSVSLLGEMALKDD

SEQ ID NO: 1172 - protein, 1221 aa, Unknown
  Description of Unknown: uncultivated organism with predicted taxonomy: Bacteroides sp. CAG:545
  MG16-86 effector
MKKVLGLDLGVGSVGWSLVNVDDNYKPTEILGIGSRIISLSPDESSEFTSGNAASKNQKRTQKRTARKGYDRYQMRRQALTEKLRELKMLPDEHLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHIRPEQKKDIFEYLDNNEKINATTLYKILDIGKGDGWSVDKALSKGFTGNTTKVAIAKVLGKEHNTKKSDLLRFDLRLKENGVNKDTGEIIYEIDPTCENEPLYRLWHVIYSINDKDALRQALTNQFGINDGESLRELTKIDFVKQGYGSRSAKFMRKLLPALMDGARYSEACDMIGINHSGSLTKSENEARELLHTIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQLVQTQYISRKAMEILKQVCHNVYGSSGEVTSYLRRIWGYDEILHSLDLPRYREGGMTAEVSYDHLGQTHTEERIKDWSKRLDHRHHAIDALTIACTRQSIIQRLNNLSAMSAVAGESMSLDKWTLAQPHFSVQEVSDNVSRILVSFKAGKKVATPGKRYVYRGGKRILAQEGLLIPRGALCEESVYGRINSLEKGVPVKKLFERVDDIVKPGIRTAVEERLRACDNDVKVACVSLKKEPLYLDVEKTIPLEYGTCYKAEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYLRSQYETTLDDSAGARMMKKFYRIKSIKSLFALHPRKVSVSLLGEMALKDD

SEQ ID NO: 1173 - protein, 1221 aa, Unknown; identical to SEQ ID NO: 1172
  Description of Unknown: uncultivated organism with predicted taxonomy: Bacteroides
  MG16-87 effector

SEQ ID NO: 1174 - protein, 1219 aa, Unknown
  Description of Unknown: uncultivated organism with predicted taxonomy: Bacteroides
  MG16-88 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDKVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIADKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDNVSQILVSFKAGKKVTTPGKRYVYRGGKRILAQKGLLIPRGALCEESVYGRIHSLEKGVPVKKLFERVDDIVKPGIRAAVEERLRACDNDVKVACASLKKEPLYLDAEKTIPLEYGTCYKAEYVMKYALSALKPKDVEYIVDEHIRKVVSERLSEYGNDPKKAFAEPLYADKSKTIPIRAARCYTDLRQVAPVKKDANGNNIGFVKPGNNHHIAIYIDSDGMYHKSTLTFWKAVERKKYGLPVIIRKPGELWDTIIDKNIPEELAAGLPAPDWKFVMSMQQNEMFVLGMEDDEFRDAMEGKDYKTLGAHLYRVQKLEHLNFRIQYDTILDDSKAAKDMKKFYEIRSFKAFWALHPRKVSVSLLGEMALKDD

SEQ ID NO: 1175 - protein, 1221 aa, Unknown; identical to SEQ ID NO: 1118
  Description of Unknown: uncultivated organism with predicted taxonomy: Bacteroides sp. CAG:709
  MG16-89 effector

SEQ ID NO: 1176 - protein, 1223 aa, Unknown
  Description of Unknown: uncultivated organism with predicted taxonomy: Bacteroides sp. CAG:770
  MG16-90 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVFTEAIVNEIRNEIIYYQRPLKSCKHLVSVCEFMQRELFDADHNPIRNGKGKIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVGSNQVNADTGEVLMEISAECEREPLYRLWHIIYSISDKNEQKSALKNQFGISDDSMLESLCKIDFVKQGYSSRSFKFMRKILPSLMDGAKYSEACDVIGINHSDSITKAENQARELLTRLPQLQKNELRQPVVEKILNQMINVVNAVIDKYGAIDEIRVEMARELKLSKAGRESAAKNIRTREKANEEIAKRIEELDLVPSKNKILKYRLWEESGKRCFYCGQPVSATEFLNGLDVEIEHIVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVAGILVSFKSGKRVTTPGKRYVYKAGRRIVAQENILVPRGALSEESVYGRIKSIEEKVPVKKLFERVDDIVKPRIRYLIRERLETFGGDCSKAVSSLKKSPLYLDEENTIMLEYGSCFKYSYVKKSKLIQLDKKDDFINVSLIVDKHIREVVTARLAAFGGDTKKAFAEPLYADEAGKIQIRTVRCYTNSTVVPVKKDADGNDIGFVKPGNNHHIAIYKDADGKYQESIVTFCDAVERKKYGIPVVVRKPAAVLDTVIDKNVPEDLARGLPSPEWTFVMSMQQNEMFVLGMGDDEFNDALAGRDYKSLGEHLYRVQKLASLYYVFRSQYETKLDDSNNALAMRKFYRVRSFNALFSLNPRKVSISLLGEISLKDD

SEQ ID NO: 1177 - protein, 1223 aa, Unknown; identical to SEQ ID NO: 1176
  Description of Unknown: uncultivated organism with predicted taxonomy: Bacteroides sp. CAG:770
  MG16-91 effector

SEQ ID NO: 1178 - protein, 1219 aa, Unknown; identical to SEQ ID NO: 1151
  Description of Unknown: uncultivated organism with predicted taxonomy: Alistipes sp. CAG:514
  MG16-92 effector

SEQ ID NO: 1179 - protein, 1219 aa, Unknown; identical to SEQ ID NO: 1151
  Description of Unknown: uncultivated organism with predicted taxonomy: Alistipes sp. CAG:514
  MG16-93 effector

SEQ ID NO: 1180 - protein, 1221 aa, Unknown
  Description of Unknown: uncultivated organism with predicted taxonomy: Bacteroides sp. CAG:545
  MG16-94 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSYNVSRILVSFKAGKKVTTPGKRYVYRGGKRILAQEGLLIPRGALCEESVYGRIHSLEKEVPVKKLFERVDDIVKPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDPKGNDIGFVKPGNNHHIAIYRDAEGTYHENVVTFWDTVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETALDNSAGARMMKKFYRINSIKSLFALHPRKVSVSLLGEMALKDD

SEQ ID NO: 1181 - protein, 1221 aa, Unknown
  Description of Unknown: uncultivated organism with predicted taxonomy: Bacteroides sp. CAG:709
  MG16-95 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPILDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENCVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQIHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRVRSFNALFNLHPRKVAVSLLGEMSLKND

SEQ ID NO: 1182 - protein, 1189 aa, Unknown
  Description of Unknown: uncultivated organism with predicted taxonomy: Bacteroides
  MG16-96 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKISQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKMIPIRAVRCYTSLAQVAPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLTSIDYYFRSQYETTLDDSAGARMMK

SEQ ID NO: 1183 - protein, 1221 aa, Unknown
  Description of Unknown: uncultivated organism with predicted taxonomy: Bacteroides
  MG16-97 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPKELSEDNIDEIRNKIIFYQRDLKSCKHLVSQCEFMTRSFLDANHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFSSIDEIRVEMARELKLSKEGRAATAKNIRNREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGVLCEESVYGRIHSLEKEVPVKKLFERVDDIVKPGIRAAVEERLRAYDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKSGEIWDILIDKNIPEELAAGLPAPDWKFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1184 - protein, 1220 aa, Unknown
  Description of Unknown: uncultivated organism with predicted taxonomy: Bacteroides sp. CAG:770
  MG16-98 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVLDLWTLRARAATPGEKLSLAEIGRVLYHLNQKRGYRHSKEDDSADKTQRDYVQAVNKRFQEIKDEGLTIGQHFAVKLKESEVITDKGAFYNYRIKEQVFPRAAYVEEFDRIIQCQREFYPEVFTEAIVNEIRNEIIYYQRPLKSCKHLVSVCEFMQRELFDAEQNPIRNRKGEIVVAGPKCAPKSSPLAQVCKIWEEINNIRVTNKENDEYFISIDNKHEIFDFLNTHEKMKADDLFKILGIAKNSGWSADKAMSKGMVGNTTRVALMKALKGRRDIDEILRFDLREVESNQVNADTGEVLMEIGAECESEPLYRLWHIIYSISDKNEQKAALEKLFGITDESMLESLCRIDFVKQGYSGRSFKFMRKILPSLMDGAKYSEACDVIGINHSDSITKAENQTRKLLTKLPQLQKNELRQPVVEKILNQMINVVNAVIGKYGAIDEIRVEMARELKLSKEGRESAAKNIRAREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKKVTTPGKRYVYKSGRRIVAQENILVPRGALSEESVYGRIKSIEEKVPVKKLFERVDDIVKPRIRHLVRERLEACGGDCSKAVSSLKKSPLYLDEENTIMLEYGSCFKPEYVIKYSLNSIKTKDAASIVDKHIREVVTARLAAFGDDPKKAFAEPLYADEAGKIQIKTVRCYTGLCQVVPVKKDAAGNDIGFVKPGNNHHIAIYKDADGKYQESIVTFCDAVERKKYGIPVVVRNPAAVLDTIIDKNVPEDLAGGLPSPEWTFVMSMQQNEMFVLGMGDDEFNDAMAGMDYKSLGEHLYRVQKLATSDYFFRSQYETKLDDTKNALSMKKYYRTRSFKALFALNPHKVSISLLGEISLKDD

SEQ ID NO: 1185 - protein, 1219 aa, Unknown
  Description of Unknown: uncultivated organism with predicted taxonomy: Bacteroides sp. CAG:709
  MG16-99 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQSHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRDSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLKACDNDVNAACASLKKEPLYLDAEKTIPLEYGTCYKAEYVMKYALSALKPKDVEYIVDEHIRKVVSERLSEYGNDPKKAFAEPLYADKSKTIPIRAARCYTDLRQVAPVKKDANGNNIGFVKPGNNHHIAFYIDSDGMYHKSTLTFWKAVERKKYGLPVIIRKPGELWDTIIDKNIPEELAAGLPAPDWKFVMSMQQNEMFVLGMEDDEFRDAMEGKDYKTLGAHLYRVQKLEHLNFRIQYDTILDDSKAAKDMKKFYEIRSFKAFWALHPRKVSVSLLGEMALKDD

SEQ ID NO: 1186 - protein, 1221 aa, Unknown
  Description of Unknown: uncultivated organism with predicted taxonomy: Bacteroides sp. CAG:709
  MG16-100 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKVVISGPKVAPKSSPIFQVCKIWEEINNLSIRNKENDELHISPEQKKEIFEYLDNNEKITSAALYKILGIGKGDGWSVDKALSKGFTGNTTKVAISKSLGKANDAKKRDLMRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACNVIGVNHSGSLTKSENEARELLQRIPQLQKNELRQPVVEKILNQMINVVNAVIEKFGGVDEIRVEMARELKLSKEGRAATAKNIRDREKENKEIAEKIIELDVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKACDNDVKAACTSLKEEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKRDVAGNDIGFVKPGNNHHIAIYRDADGKFHECVVTFWDAVERKKYGIPVIVRNPDEVWDVVIDKNVPEELAAGLPALGWSFVMSLQQNEMFILSMEDDEFRDAMAEADYKALGAHLYRVQKLTGSDYYFRSHYETLLDDSAGARIMKKFYRVRSFNALFNLHPRKVSVSLLGEMALKDD

SEQ ID NO: 1187 - protein, 1221 aa, Unknown
  Description of Unknown: uncultivated organism with predicted taxonomy: Bacteroides sp. CAG:545
  MG16-101 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLSEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEETNNLSIRNKENDELHISPEQKKDIFEYLDNNEKINATALYKILGIGKGDGWSVDKALSKGFTGNTTKVAMAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTSEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKDVPVKKLFERVDDIVKPGIRAAVEERLRACDNDVKVACASLKKEPLYMDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIYYVFRHQYETQLDDSKGALVMKKFYRTASFKALFALHPRKVSVSLLGEMALKDD

SEQ ID NO: 1188 - protein, 1220 aa, Unknown
  Description of Unknown: uncultivated organism with predicted taxonomy: Bacteroides sp. CAG:770
  MG16-102 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKQDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDDILRFDLREVESNQVNSDTGEVLMEISAECESEPLYRLWHIIYSISDKNEQKAALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAANNIRTRKKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYCSSGDVTAYLRRIWGYDEILHSLDLPRYREGNLTGDVTYVHMGQTHTEERIKDWSKRMDHRHHAIDALTIACTRQSIIQRLNTLNAKTAIGEEQMSLDKWTLAQAHFSVADVADHVADILVSFKSGKRVTTLGKRYVYKAGRRIVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKYIREVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTVIDKNVPEDLAGGLPSPEWTFVMSMQQNEMFVLGMGDDEFNDAFAGRDYKSLGEHLYRVQKLASLYYVFRSQYETKLDDSNNALAMRKFYRVRSFNALFSLNPRKVSISLLGEISLKDD

SEQ ID NO: 1189 - protein, 1220 aa, Unknown
  Description of Unknown: uncultivated organism with predicted taxonomy: Bacteroides sp. CAG:770
  MG16-103 effector
MKKILGLDLGVGSVGWSVVSCDDEHKPVEILGMGSRIVPLTPDESNEFSSGNAASKNQSRTQKRTARKGYDRYQSRRKALTDKLRELDMLPDETLIKLPVLDLWTLRARASTPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQRKFYPEVLTEANVNEIRNEIIYYQRPLKSCKHLVSVCEFMQRELFDADHNPIRNGKGKIVVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEIGAECESEPLYRLWHIIYSISDKNEQKSALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKSGRESAAKNIRTREKANEEIAKRIEELGLVPSKNKILKYRLWEESGKRCFYCGQPVSATEFLNGLDVEIEHVVPKSLLFDNSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHYLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDAVSIVDNHIREVVTARLAAFGDDPKKSFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDAMVGMDYKSLGEHLYRVQKLASLYYVFRSQYETKLDDSNNALAMRKFYRVRSFNALFSLNPRKVSISLLGEISLKDD

SEQ ID NO: 1190 - protein, 1221 aa, Unknown; identical to SEQ ID NO: 1119
  Description of Unknown: uncultivated organism with predicted taxonomy: Bacteroides
  MG16-104 effector

SEQ ID NO: 1191 - protein, 1220 aa, Unknown
  Description of Unknown: uncultivated organism with predicted taxonomy: Bacteroides sp. CAG:770
  MG16-105 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKNEGLTIGQHFAEKLKESEIITDKGSFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEINNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEISAECEREPLYRLWHIIYSISDKNEQKSALKNQFGISDESMLESLYKIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAANNIRTRKKVNEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENRISQTKRNRLLTPADKIPKDFIARQLVQTQYISRKAMEILNQVCRNVYGSSGDVTAYLRRIWGYDEILHSLDLPRYREGNLTENVTYVHRGQTHTEERIKDWSKRLDHRHHAIDALTIACTRQSIIQRLNTLNAKTAIGEEQMSLDKWTLAQTHFSVADVADHVADILVSFKSGKRVTTPGKRYVYKAGRRRVAQENILVPRGALSEESVYGRIKSIEEKVPVKKLFERVDDIVKPRIRRLIRERLEACGGDCSKAVSSLKKSPLYLDEENTIMLEYGSCFKPEYVIKYSLNSIKAKDAVSIVDKHIREVVIARLAAFGDDPKKAFAEPLYADEAGKIQIKTVRCYTGLSQVVPVKKDADGNDIGFVKPGNNHHIAIYKDADGKYQESIVTFRDVVERKKYGIPVVVRNPAAVLDTIIDKNVPEDLAGGLPSPEWTFVMSMQQNEMFVLGMGDDEFNDAMSGMDYKSLGEHLYRVQKLASLYYVFRSQYETKLDDSKGALTMKKFYRTASFKALFALNPRKVSISLLGEISLKDD

SEQ ID NO: 1192 - protein, 1221 aa, Unknown
  Description of Unknown: uncultivated organism with predicted taxonomy: Bacteroides sp. CAG:545
  MG16-106 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVLPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTQKSDLLRFDLRLKENGVNKDTGEIIYEIDPTCENEPLYRLWHVIYSINDKDALRHALTNQFGINDGESLRELSKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLDKEVPVKKLFERIDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYKDAEGTYHESIVTFWDSVERKKYGLPVIIRKPGEIWDIIIDKNIPEELAAGLPAPDWQFVMSMQQNEMFVLGMEDDGFRDAMEVKDYKTLGAHLYRVQKLTSIDYYFRSQYETTLDDSAGARMMKKFYRIKSIKSLFALHPRKVSVSLLGEMALKDD

SEQ ID NO: 1193 - protein, 1221 aa, Unknown
  Description of Unknown: uncultivated organism with predicted taxonomy: Bacteroides sp. CAG:545
  MG16-107 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEAREFLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1194 - protein, 1220 aa, Unknown; identical to SEQ ID NO: 1111
  Description of Unknown: uncultivated organism with predicted taxonomy: Bacteroides sp. CAG:770
  MG16-108 effector

SEQ ID NO: 1195 - protein, 1221 aa, Unknown
  Description of Unknown: uncultivated organism with predicted taxonomy: Bacteroides sp. CAG:709
  MG16-109 effector
MKKILGLDLGVGSIGWSLINADKDNKPIAILGLGSRIISLSPDESSEFTSGNAASKNQKRTQKRTARKGYDRYQMRRQSLTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRIHSLEKGVPVKKLFERVDDIVKPGIRAAVEERLRACDNDVKVACASLKKEPLYLDAEKTIPLEYGTCYKAEYVMKYALSALKPKDVEYIVDEHIRKVVSERLSEYGNDPKKAFAEPLYADDAKTIPIRAVRCYTGLAQVVPVKKDSKGNDIGFVKPGNNHHIAIYRDADGAYHENVVTFWDTVERKKYGLPVIIRKPGEIWDILIDKNIPEELAAGLPAPDWKFVMSMQQNEMFVLGMEDDEFRDAMEVKDYKTLGAHLYRVQKLASSYYVFRHQYETQLDDSKCAQIMKKFYRAQSFKALFALHPRKVSVSLLGEMALKDD

SEQ ID NO: 1196 - protein, 1221 aa, Unknown; identical to SEQ ID NO: 1195
  Description of Unknown: uncultivated organism with predicted taxonomy: Bacteroides sp. CAG:709
  MG16-110 effector

SEQ ID NO: 1197 - protein, 1221 aa, Unknown; identical to SEQ ID NO: 1150
  Description of Unknown: uncultivated organism with predicted taxonomy: Bacteroides sp. CAG:770
  MG16-113 effector

SEQ ID NO: 1198 - protein, 1221 aa, Unknown
  Description of Unknown: uncultivated organism with predicted taxonomy: Bacteroides sp. CAG:545
  MG16-114 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQESLLIPRGALCEESVYGRIHSLEKEVPVKKLFERVDDIVRPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLACIYYVFRHQYETQLDDSKGAQIMKKFYRAQSFKALFALRQRKVSVSLLGEMALKDD

SEQ ID NO: 1199 - protein, 1221 aa, Unknown
  Description of Unknown: uncultivated organism with predicted taxonomy: Bacteroides sp. CAG:770
  MG16-115 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKKSEIVTDKGPFYNYRIKEQVFPRDAYIEEFDRIMDCQKTFYSEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1200 - protein, 1221 aa, Unknown
  Description of Unknown: uncultivated organism with predicted taxonomy: Bacteroides
  MG16-116 effector
MKKVLGLDLGVGSVGWSLVNVDDNYKPTEILGIGSRIISLSPDESSEFTSGNAASKNQKRTQKRTTRKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRNLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKAEYVMRYALSALKPKDVEFIVDEHIRKVVSERLSEYGNDLKKAFAEPLYADKSKTIPIRAVRCYTGLAQVVPVKKDSKGNAIGFVKPGNNHHIAIYKDADGTYHENVVTFWDTVERKKYGLPVIIRKPGEIWDILIDKNIPEELAAGIPAPDWKFVMSMQQNEMFVLGMEDDEFRDTMEVKDYKTLGAHLYRVQKLTSIYYVFRHQYETQLDDSKGAQIMKKFYRAQSFKALFSLHPRKVSVSLLGEMALKDD

SEQ ID NO: 1201 - protein, 1220 aa, Unknown
  Description of Unknown: uncultivated organism with predicted taxonomy: Bacteroides sp. CAG:770
  MG16-118 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKEDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSSKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDAVGINHSDSITKAKNQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKKVTTPGKRYVYKAGRRRVAQENILVPRGALSEESVYGRIKSIEEKVPVKKLFERVDDIVKPRIRHLVRERLEACGGDCSKAVSSLKKSPLYLDEENTIMLEYGSCFKPEYVIKYSLNSIKAKDAVSIVDKHVREVVTARLAAFGDDPKKAFAEPLYADEAGKIQIKTVRCYTGLSQVVPVKKDADGNDIGFVKPGNNHHIAIYKDADGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISMLGEISLKDD

SEQ ID NO: 1202 - protein, 1221 aa, Unknown
  Description of Unknown: uncultivated organism with predicted taxonomy: Bacteroides sp. CAG:709
  MG16-119 effector
MKKILGLDLGVGSIGWSLINADKDNKPIAILGLGSRIISLSPDESSEFTSGNAASKNQKRTQKRTARKVYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKAYDNDVKAACTSLKEEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1203 - protein, 1221 aa, Unknown; identical to SEQ ID NO: 1135
  Description of Unknown: uncultivated organism with predicted taxonomy: Bacteroides sp. CAG:709
  MG16-120 effector

SEQ ID NO: 1204 - protein, 1223 aa, Unknown
  Description of Unknown: uncultivated organism with predicted taxonomy: Bacteroides sp. CAG:770
  MG16-121 effector
MKKILGLDLGVGSVGWSVISCDDEHRPLEIVGMGSRIVPLTPDESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQDIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDADHNPIRNGKGKIVVAGPKCAPKSSPLARVCKIWEEINNIRVTNKENDEYFISIDNKHEIFDFLNTHEKMKADDLFKILGIAKNSGWSADRAMSKGMVGNTTRVALMKALKGRRDIDDILRFDLRDVESNQVNADTGEVLMEISAECESEPLYRLWHIIYSISDKNEQKSALKNQFGISDESMLESLCKIDFVKQGYSSRSFKFMRKILPSLMDGAKYSEACDVIGVNHSDSITKAENQARELLARLPQLQKNELRQPVVEKILNQMINVVNAVIDKYGAIDEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGHGENAFEDYLKRVETAFKENRISQTKRNRLLTPADKIPKDFISRQLVQTQYISRKAMEILNQVCRNVYGSSGDVTAYLRRIWGYDEILHSLDLPRYREGNLTGDVTYLHKGQTHTEERIKDWSKRLDHRHHAIDALTIASTRQSIIQRLNTLNAKTAIGEEQISLDKWTLAQAHFSVADVADHVADILVSFKSGKKVATPGKRYVYKAGRRIVAQENILVPRGALSEESVYGRIKSIEEKVPVKKLFERVDDIVKPRIRHLIRERLEACGGDCSKAVSSLKKSPLYLDEENTIMLEYGSCFKYSYVKKSKLIQRDKKDDCINVSLIVDKHIREVVTARLAAFGGDTKKAFAEPLYADEAGKIQIKTVRCYTNSTVVPVKKDADGNDIGFVKPGNNHHIAIYKDADGKYQESIVTFRDAVERKKYGIPVVVRNPVEVMDTVIDKNVPEDLAGGLPSPEWTFVMSMQQNEMFVLGMGDDEFNDAMAGMDYKSLGEHLYRFQSISHADYYFRSQYETMLDNSKNAMAMKKYYRIRSFKALFALNPRKVSISLLGEISLKDD

SEQ ID NO: 1205 - protein, 1220 aa, Unknown
  Description of Unknown: uncultivated organism with predicted taxonomy: Bacteroides sp. CAG:770
  MG16-122 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKEDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDVIGVNHSDSITKAENQARELLTRLPQLQKNELRQPVVEKILNQMINVVNAVIDKYGAIDEIRVEMARELKLSKAGRESAAKNIRTREKANEEIAKRIEELGLVPSKNKILKYRLWEEFGKRCFYCGQPVSATEFLNGLDVEIEHVVPKSLLFDDSFSNKVCACRKCNAEKGNATAFDFMKGRGENAFEDYLKRVETAFKENRISQTKRNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKRVTTPGKRYVYKAGRRRVVQENILVPRGALSEESVYGRIKSIEEKVPVKKLFERVDDIVKPRIRYLIRERLETCGGDCSKAVSSLKKSPLYLDEENTIMLEYGSCFKPEYVIKYSLNSIKAKDAVSIVDNHIREVVTARLAAFGDDPKKAFAEPLYADGAGKIQIRTVRCYTGLSQVVPVKKDADGNDIGFVKPGNNHHIAIYKDADGKYQESIVTFCDAVERKKYGIPVVVRNPVEALDTIIDKNVPEDLAGGLPSPEWTFVMSMQQNEMFVLGMGDDEFNDALAGMDYKSLGEHLYRVQKLATSDYFFRSQYETKLDDSKGASAMRKFFRTASLKALFALNPRKVSISLLGEISLKDD

SEQ ID NO: 1206 - protein, 1221 aa, Unknown
  Description of Unknown: uncultivated organism with predicted taxonomy: Bacteroides sp. CAG:545
  MG16-123 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKVLGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQKLASIDYYFRSQYETALDNSAGARMMKKFYRTNSIKSLFALHPRKVSVSLLGEMALKND

SEQ ID NO: 1207 - protein, 1221 aa, Unknown
  Description of Unknown: uncultivated organism with predicted taxonomy: Bacteroides sp. CAG:770
  MG16-126 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLDLWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSDELVISGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLCGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMAAVAGESMSLDKWTLAQPHFSVQEVSDNVSRILVSFKAGKKVTTPGKRYVYRGGKRILAQEGLLIPRGALCEESVYGRIHSLEKGVPVKKLFERVDDIVKPVIRAAVEERLRACDNDVKVACASLKKEPLYLDAEKTIPLEYGTCYKAEYVMKYALSALKPKDVEYIVDEHIRKVVSERLSEYGNDPKKAFAEPLYADKSKTIPIRAVRCYTGLAQVVPVKKDSKGNDIGFVKPGNNHHIAIYRDADGTYHENVVTFWDTVERKKYGLPVIIRKPGEIWDIIIDKNIPEELATCLPAPDWQFVMSMQQNEMFVLGMEDDEFRDAMEGKDYKTLGAHLYRVQKLTSIDYYFRSQYETTLDDSAGARMMKKFYRIKSIKSLFALHPRKVSVSLLGEMALKDD

SEQ ID NO: 1208 - protein, 1221 aa, Unknown
  Description of Unknown: uncultivated organism with predicted taxonomy: Bacteroides sp. CAG:709
  MG16-127 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNERITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKAYDNDVNAACASLKKEPLYLDAEKTIPLEYGTCYKREYVIKYPISSLKAKDVESIIDGHIRQIVSERLSEYGNDPKKAFAEPLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFMDAMAEADYKALGAHLYRVQKLAGSDYYFRSHYETLLDDSAGARIMKKFYRISSSKALFALHPRKVAVSLLGEMSLKND

SEQ ID NO: 1209 - protein, 1221 aa, Unknown
  Description of Unknown: uncultivated organism with predicted taxonomy: Bacteroides sp. CAG:770
  MG16-128 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTTVEERLRACDNDVKVACASLKKEPLYLDVEKTIPLEYGTCYKAKYVMRYALSALKPKDVEFIVDEHIRKVVSERLSEYGNDPKKAFAEPLYADKSKMIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1210 - protein, 1221 aa, Unknown
  Description of Unknown: uncultivated organism with predicted taxonomy: Bacteroides sp. CAG:709
  MG16-129 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYREGKRILAQDGLLIPRGALSEESVYGRISALEKNVLVKKLFERVEDIVKPGIRAVVEDRLMACDNDVNAACASLKEEPLYLDAEKTIPLEYGTCYKREYVIKYPISSLKTKDVESIIDGHIRQIVSERLSEYGNDPKKAFAEPLYADDAKTIPVRTVRCYTGLDQVVPVKRDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQSLSRSDYYYRCQYETQLDNSNGAMRMKKFYRVRSFNALFNLHPRKVAVSLLGEMSLKND

SEQ ID NO: 1211 - protein, 1220 aa, Unknown
  Description of Unknown: uncultivated organism with predicted taxonomy: Bacteroides sp. CAG:770
  MG16-130 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRYSKEDDSADKTQRDYVQAVNKRFQEIKNEGLTIGQHFAVKLKASEVITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEINNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEISAECEREPLYRLWHIIYSISDKNEQKSALKNQFGISDESMLESLCKIDFVKQGYSSRSFKFMRKILPSLMDGAKYSEACDVIGINHSDSITKAENQIRKLLTKLPQLQKNELRQPVVEKILNQMINVVNAVIDKYGAIDEIRVEMARELKLSKAGRESAANNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKKVTTPGKRYVYKAGRRRVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKTKDAASIVDKHVREVVTERLAAFGDDPKKAFAEPLYADEVGKIQIKTVRCYTGLSQVVPVKKDADGNDIGFVKPGNNHHIAIYKDADGKYQECIVTFRDAVERKKYGIPVVVRNPVEALDTIIDKNVPEDLAGGLPSPEWTFVMSMQQNEMFVLGMGEDEFNDAMAGMDYKSLGEHLYRVQKLASSDYFFRSQYETKLDDTKNALLMKKYYRTRSFKALFALNPHKVSISLLGEISLKDD

SEQ ID NO: 1212 - protein, 1221 aa, Unknown
  Description of Unknown: uncultivated organism with predicted taxonomy: Bacteroides sp. CAG:709
  MG16-131 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFVSRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSMQEVSDKVGGILVSFKAGKKVTTPGKRYTYRRGKRILAQDGLLIPRGALSEESVYGRISALEKNVLVKKLFERVEDIVKPGIRAVVEDRLKACDDDVKAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1213 - protein, 1221 aa, Unknown
  Description of Unknown: uncultivated organism with predicted taxonomy: Bacteroides
  MG16-132 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQKGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRALRCYTGLAQVVPVKKDSKGNAIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1214 - protein, 1257 aa, Unknown
  Description of Unknown: uncultivated organism with predicted taxonomy: Bacteroidales
  MG16-133 effector
MKKILGLDLGTTSIGWALINAEDNNKPTEIQDIGVRIVPLAENEGDKFTKGQDITVNADRTRARGQRRNYDRFQLRRQALTEKLRSLDMLPDEHLIKLPVMELWQLRANAVTQKVSLNELGRVLYHLNQKRGYKHSRTDSNDSKQRAYVKEINNRYAELQKLGMTIGQYFAQKLEETAIKQNGKIFYAFRIKEQIYPRQAYEEEYDAIMKCQQTFYPEILTESIIEEIRNRIIYYQRDLRSCKHLVTVCEFEKRCFYDADGNVKRNQKGEIIYDGPKVVPRTSPLFQVFKNWQSINNIRFHNRKNEYLFITKEQKQQIANVMANQEVLKLKDVQEILGVTSKSGWYCDKAIKAGIKGNITKCAIIASLSSLPQSKIREITRFNLETETTNMVDEETGELLVRIKNTYQEEPLYKLWHIIYSIKNDNERLNTIISFLKDFDIEDISISNALNDLDFVTPGYANLSAKAISKILPYMMEGLDYSDSCEYVGYNHSDSLTKEENENRILLDKIPALKKNELRQPTVEKILNQTISIFNEINANLLQKGERVDEVRIELARELKQSKEEREKTDRGIRKQQKANEVFANLLKEQGVRPTRNRILKYRLWRESYETCFYCGQPISFKEFLKFSDVEREHVIPKRLLYDDSFANQVCSCRKCNAEKGGRTAIDYMRTTQHLQPYLEKVDKMFQEHKISGKKHAHLLASYDDYLSRKKEGKETKDDIIIWEEAIERQLRLSQYISKKAQELLKKSCREVIATSGSVTDLIRHTWGYDTILHELNLPCYKEAGLTTFIKEENTGQQKEVIKDWTKRLDHRHHAVDALTVACTSRSIIQHINTLHASREVMRGDVKTPRKEWENNDLLQQWIKEKMPFDRQYVLQKVASILVSMKSGKKSTVPGKRKIYIKGKPIVMQSGLRIPRGQLHEQTVYGAIKQYSKDKKGNLIEKKEIVTRYKMGVGSVGFVFNGKETCDVVFDKKNNRYVIADGIDKAINYIIDKHIRDIVRERLNEAFPDGETYRTEAEIALAAGKTYNGKERSMKALEQLKALYEQPLYADKNKHIVIKSVRCFTGLSAVQPLRYNDKNEPTSFVLTKNNHHVAIYLDEKGELKECIYTFWQAVERSKYKLPLIIKEPKSLWDEILERENNGEIFPDTLITSLPSPNWTFVESLQLNDMFVMDMDDVKFENFISSNNYEEIGKRIYRVQSLSSHDYVFRHHTDTTSSMMPEAALCRKFIRIKSLKAYIEHHPHKVQLSLLGKILTKR

SEQ ID NO: 1215 - protein, 1243 aa, Unknown
  Description of Unknown: uncultivated organism
  MG16-134 effector
MKKILGLDLGTNSIGWAVVNADENGNPVSIEGMGSRIVPLTADDTNEFTKGNAISKNQSRTEKRTARKGYDRYQLRRNKLTLEFRKLNMLPDEQLIKLQPLELWQLRATAATEGHKLTLPEIGRVLYHINQKRGYKHAKSDESADTKQKAYVAEVNARYAMIKERKQTIGQFFAEKLKENEIETSKGKLYTYRIKEQVFPRRAYEAEFDQIMECQRVFYPDVLTNEEINRLRNEIIFYQRKLKSCKHLVSLCEFEKREYKNKDGKIVIDGPKVAPKSSPLFQVCKIWEEINNITLRNRRNDELYISMDQRQAMFDFLDTHEKMTLSDLYSILGISKNDGWWGGKAIGKGLQGNTTKIALKNALGDFENADNLLQFKLESIDSNFVDEETGEIIQIINPNLEKEPLYDLWHTVYSISDKEELANALKKKFNINDEDIINNLYAIDFVKPGYGNKSAKAIRRILPYLQQGLKYSDACEYAGFRHSESLTKTENEQRQLLDKLPAIQKNALRQPIVEKILNQMINVVNALMVEYKEHFYSIRVELARELKQSKDDRNTTYLQNEAMERLNDAIAKRLNSEGIKTTKRILEKYKYIFPTKGCIDKKTGKFVSKNFENLSTVNQCIYCGKSFSLTAALNGDGYEVEHIIPRDLICDNSQSNKVLSCRSCNSKKSNKTAFDFMRGQGEQALEDYIARIEKWYKDGIISPAKREHLLLSHEDYLKRKKEGKTTDEDKKYWEDFVSRQAGETQYISREAIKILKQCCKNVNATSGAVTAILRHLWGYDEILHQLDFERYKKAGLTKIVTWESDHGKNKHTKEQIVNWTKRIDHRHHAIDALVIACTQQGFVQRINTLNADETKDLMKKQIESSGVKFEEKKDLLNKYLASLTPFSTQTVADNVDKILVSFKAGKKSASTGKRIKYVKGKKVVLQKGIIIPRGALHEEGVYGQIEINGKKEIVKKYKLGKGAQGFVFTGKETYEKKVNNKTGEIHVVDKIKNVLDSIVDVNIRSKILQRLNQGFEDGKDYRDDVKKALDNLNDLDKNPIFADDNNTIPIRTVRCRTGLSAVVPIKHNEKGEPIGFVKPGNNHHIAIYSDKNGNLHEHTVTFWHAVERKKYGIPVIIENPQSVWDSIIDKQLPESFLENLPDVKWTFEISLQQNEMFVLGMENESFEDAVRNNDFSTISKYLYRVQSISESDYWFRLHIETQNDKTPSAKLANKYHRVKSLKSFHELNPHKVYISVIGKIKAL

SEQ ID NO: 1216 - protein, 1078 aa, Unknown
  Description of Unknown: uncultivated organism with predicted taxonomy: Porphyromonas sp. oral taxon 278
  MG16-135 effector
MKRILGLDLGTNSIGWAVVNTDENDKPVSIENMGSRIVPLTSDDTNEFTKGNAITKNQARTVKRTARKGYDRYQLRREHLTAELRKLKMLPDERLIKLPVLELWELRGRAASKGNQLTLSEIGRVLYHINQKRGYKHAKSDESADTKQKAYVAEVNARYAMIKERNQTIGQFFAEKLKENEIETSKGKFYTYRIKEQVFPRKAYEAEFDQIIECQKEFYPDILTNEEINRLRNEIIFYQRRLKSCKHLVSFCDFEKREYINKVGKVVYGGPKVAPKSSPLFQLCKIWEEVNNLTLRNRKNDELFITIEQRQAMVDFLDTHEKLTLSDMYSILGISKQDGWWGGKAIGRGLQGNTTKIALKKALGDFVNADTLLQFNLKQTDSNLVDEVTGEILQVIDPKLEKEPLYDLWHTIYSISDKEELANALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFDSIRVELARELKQSKDERNVTFLQNEAMQRLNDSIANRLSSEGIKPTKRTIEKYKFIFPTKGCFDKRTGKFITKNFENLSTVNRCIYCGQPFSLSAALNGDGYEVEHILPRDLICDNSQSNKVLSCRKCNSIKSNKTAFDFMRSQGEHAFETYLERVESWYKDGIISPSKRERLLLSHEDYLERKRKDKATDIDKKYWEDFVSRQAGETQYISREAIRILKQCCRYVNATSGSITATLRHLWGYDEILHQLNFERYKQAGLTKIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKKTATIGKRIEYKHGNKHIVQKGIIIPRGALHEEGVYGRIEINGKKEIVKKYKLGKGAQGFVFTGKETYAEKINKKTGGIQIEDKIKNVLDSIVDSNIRAKVLQRLNQGFEEGQDYRNNVKKALDNLNNLDDNPIFADKNNTIPIRTVRCRTGLSAVVPIKKNERGEAIGYVKP

SEQ ID NO: 1217 - protein, 1217 aa, Unknown
  Description of Unknown: uncultivated organism with predicted taxonomy: Bacteroidales
  MG16-136 effector
MRKILGLDLGVGSIGWSLIETDAEDNPKAILGMGSRIVPLSTDDANEFSSGNAISKNQKRTQKRTQRKGYDRYQLRRALLTQKLRELGMLPDERLIKLPVLELWQLRADAATPGKQLELKEIGRVLYHINQKRGYRHSRSDDGEDKSQKDYVQQVNQRYREILDEGTTIGQHFSKKLADNEVITPKGKFYTYRIKEQVFPRDAYVEEFDRIMECQRRFYPDLLTESTIREIRDEIVFFQRPLKSCKHLVSVCEFAMREYKTKEGKSILAGPKVAPRSSPLFQVCKIWESVNNLSLKNRSGEVYHFSQEERRKMFDFLDNHDKMAVTDLYKLLGISKKEGWWGGKAIGKGLQGNTTKAALAKALGERQDLLQFQLETIDSRQIDTETGEVLKTISPSFEKEPLYRLWHILYSMHERSEVAAALERQFGITAPDTVDRLFAIDFVKAGYGNKSARFIREILPYLQAGMQYSQACDYIGINHSNSLTIEENASRVLLDRLPQLQKNELRQPVIEKILNQMVAVVNALLSQYGPIDEIRVELARELKQSRDERNDAYLSINKRERENKVIEERIREYGISPSKSRIQKYRLWEESNHLCFYCGHPVGAAEFLSGSGVEIEHIIPRSLLFDDSFANKVCACRQCNAEKGNSTAFDYMKSKPANDFEDYLKRVEKYFTEKRISKTKRERLLTPASEIPQDFIDRQLRQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKMVATPGKRYTYKNGKKELVQDGLLIPRGALSEESVYGQITTIEPSVPVKKLFEDPSLIFKPYIRELVERRIKECGGDWKKARASIGKKPIWLDTEETVALEFATCWKKEYVIKYPVSSLKAKDVDSIVDRHIREIVRKRIDEVGEKEAFKTPIYTDDAQSIPLRSVRLFTGLDAVEPVKYVDGVPVGFSKPGNNHHIAIYRDQDGNRSEHVVSFWHAVERKRYGLPVIIRDTDSVWEQIEGESLPESFLKNLPQPGLKLELSLQQNEMLILGMKEDEFNDAIREKDTRRLNKHLYRVQKLSTMYYVFRYHTETQIDDSKGALEMHKFYRTVSFRALDALFPRKVRISVTGELIPIQ

SEQ ID NO: 1218 - protein, 1045 aa, Unknown
  Description of Unknown: uncultivated organism with predicted taxonomy: Prevotella
  MG16-137 effector
MKKILGLDLGTTSIGWALVNVDDNNNPVDIQDIGVRRVPLSENEGDKFTKGQDITVNADRTRARGTRRNYDRYQLRRQALTEKLRQLNMLPDENLIMLPIMDLWQLRADAVTKKVSLNELGRILYHLNQKRGYKHSRTDANDSKQREYVKEINNRYAKLLESKMTIGQLFANKLAETAVVQDGKIFYNYRIKDQIYPRNAYEEEYDAIMKCQQKFYPEILTDAIIDEIKNRIIYYQRDLRSCKHLVSICEFEKRCFYDEDGNVKRNKKGDIFYDGPKVAPRTSPLFQVFKDWQSINNLRFHNRRNEYLYITKEQKEQIADFMEHHEILKLKDVQSLLDITAKSGWYCDKAIKAGIKGNSTKCAILSSLSSLPHSKIAEITRFNLETETTNIVDEETGEMLVRIRNTYQNEPLYRLWHIIYSIKNDNERINAISKFLKEFEVEEETVINSLKDIDFVTPGYANLSAKAICKILPYMMEGLDYSDSCEYVGYNHSDSLTKEENEKRELLDKIPALKKNELRQPTVEKILNQTINVFNQINEDLSKDGERISEVRVELARELKQSKDERNETEIGIRKQQKLNDEYAKILKEEGVRPTRNRILKYRLWRESNKSCFYCEQPISFHEFLDFSETEREHIIPKKLMYDDSFANQVCSCRNCNKEKGGRTAMDYMRTKQNLQFYLDKVDKMFQDHKISGKKRSHLLASYDDYLFRKENGKETKDDILIWEKPIERQLRLSQYISRKAQELLRMTCRDVTVTTGEITALIRHTWGYDTILHDLNFSSYKEAGLTEIVKGEDSGRTREIIKDWSKRLDHRHHAIDALAVACTSRSIVQRINTLNASREEIRGEIKAPRKEWKDSNLLQQWIKEKMPFDRQYVLHKVASILISMKAGKKATVPGKRKIYKKGKPIVIQTGLRIPRGQLHEKTVYGAINQYDKGQKVMKIVTRYKMGVGSMGYVFNGKETCDVIKKKNRYEIVDGIQKALDYIVDKHIREIVKARMNEAFPEGETYLTEAEKALAEGKAYDGKARCQKALDQLRTLSERPLYADK

SEQ ID NO: 1219 - protein, 1217 aa, Unknown
  Description of Unknown: uncultivated organism
  MG16-138 effector
MKRILGLDLGVGSIGWSLIQADEDGNPQSIIDIGCRIVPLSPDDTNEFSSGNAISKNRKRAQKRSVRKGYDRYQLRRQNLTDELRGLGMLPDERLIKLPILALWQLRANAATPGKRLTLPEIGRIFYHINQKRGYLHSKSDEEDKNQRDYVQAINNRYATIKAEGKTIGQYFAQKLADSEVTTDKGKVYAFRIKEQVFPRQAYQEEFDQIIACQRIHYPEVLTDDVIHRLRDEIIFYQRPLKSCKHLVSLCEFAMREYKTTDGRSIQAGPKVTPRSSPLFQVCKIWESVNNIELKNRDGESYPFSAEERLKLFNFLDNNEKMTVTDLKRILGLGTKDKWWGGKAIGKGLQGNITKMALKKALPYHEELLSFNLKSIESRHIDTETGDILLEIAPDFEQEPLYRLWHIIYSMKDPDEMASALNRQFGIDDPTILTNLTRIDFVKAGYGNKSARFIRQILPYLQKGMKYSEACDYISINHSNSLTTAENNSRELLPHMQQLQKNELRQPVIEKILNQMVNVVNALLDKYGSIDEVRVELGRELKQSRDERNSAFLNNNKRERDNKAISERIQEMGIRASRSRILKYRLWEEAKHICFYCGQTVGVKEFLEGTDVEIEHIIPRSLFFDDSFSNKVCACRKCNAEKGNRTAYDYMKQKSDNDFADYTRRIEDAYEKKEISKTKRERLLTTAKDIPEDFIDRQLRQSQYISKKAVEMLKQVCRNVWTTSGSVTDFIRHQWGYDNILHDLNFKRYKDAGQTEIIISDHLGQVHQEERIKNWTKRLDHRHHAIDALTIASTKQSYIQRLNHLNSSRDKMFQELEAQSKEVKEKYSLLESWMRCRPHIPVSVVSQAIDGILVSFKTGKRITTPGKRFIYKSGKREVAQYGIAVPRGALSEESVYGSISCLEANVPVKKLFEHPEIIFKPYIREKVEKRINEFSGDWKAALKSLKKTPIFLRADGTEPLEYATCWKREYVIRYPLASLLKKDLPFIVDRNIRRLVSERINAVGEKDAFKEPLFADKADINPIRSVRLFTGLTQDSLSPVKYFNGYPIGYSKPGNNHHFCYYRNKNGELFEHIVSFWHAVDRKKYGIPVIIEDTDVLWEDMANRDLPQDFLKNLPPAGLKLEVSLQQNEMFVLGMPEEDFQNAIKENDQRALNKYLFRVQKISGQYNVFRRNTDTGKDEDSKAQSLGQFVRISSVRGWIHCCPHKVRISVLGEISEI

SEQ ID NO: 1220 - protein, 930 aa, Unknown
  Description of Unknown: uncultivated organism with predicted taxonomy: Bacteroidales
  MG16-139 effector
MKKKILGLDLGVGSIGWALIKTDDNQPKQIIGMGSRIVPISKDDNDQFSKGQAISKNADRTARRTTRKGYDRYQLRRALLTDVLRQNGMLPERMDEHVIDLWKLRSDAATEGHQLTLPQIGRVLYHINQKRGYKHAKADDNGDSKQTKYVEAVNQRYTDLQAEGLTIGQHFHLELLHSKVEGASGPYYTFRIKDKVFPRAAYIAEFDQIMRVQRVYYPEILTDELIDVLRNRIIFYQRPLKSCKHMVSLCEFEMRPYKTKDGRIVYGGPKCAPRTSPLAQFCAMWETANNITLTNRNNERYEFTLDARAQIVKHLCEHAVLKLTDLYKILGITKKDGWWGGKAIGKGIKGNATLNQLRDALDGKYGEWLEMPVEIEDKVNDATGEVVKTVSAEVEHAPLFQLWHAVYSLQNADELAKTLREKFQITDEAVIEALCKIDFVKPGYANKSHKFIRRILPYLMDGYMYNEACAKVGINHSNSMTAAERDARPLAERIELLQKNALRQPVIEKIINQMINLVNRLQQEYGPIDEARVELARELKQSRDERESAYKAINKNERENSTIANRILEDYGIRPSRSRIQKYRMWEESKQRCFYCGKMIDVKQFLSGADVEIEHIVPRSILFDDSYSNKVCACRECNQEKGNLTAMEYMEGKPTGEFEAYKQRVDEAFSEHRISKTKRDHLLWRRADIPQDFIERQLRQSQYIAVKAVEILQQGIRRVWTSGGSVTDFLRHQWGYDEILHTLNLPRYKQVDEMTEWVHYEHAGQEHEVERIKNWTKRLDHRHHAIDALTVALTQQSMIQRLNTLEASHDEMEKQVKEANTPYKEKKSILEKWVTEQPHFEVSEVTDKVDSILVSFRAGKRVTTPARRAIYQGGKRTIVQTGIQVPRGALTEETIYGKSGDKFVVKYPLDHPSMKPENIVDPTIRALVEK

SEQ ID NO: 1221 - protein, 830 aa, Unknown
  Description of Unknown: uncultivated organism with predicted taxonomy: Fibrobacter
  MG16-140 effector
MKKILGLDLGVSSIGWSVISVDKNGDPSEILGMGSRIVPLSTDDANEFSTGNAISKNQKRTQKRTARKGYDRYQLRRENLTAELRKHQMLPDERLIKLPVLDLWTLRANAATEGCKLSLPEIGRVLYHINQKRGYKHAKADEAGDKKQTEYIENVNKRFAMIKELGLTIGQFFANKLKESEVVSEKGTFYTYRTKEQVFPRGAYIAEFDQIIEVQRKFYPQVFTDEFINRLRNEIIFYQRNLKSCKHLVSLCEFEKREYKNKDGKIVFDGPKVAPRTSPLFQICRIWEFVNNIRLENGYKEARVLSQEERLKVVDFLDNHEKMTAKDFTKLLRLDKNDEWDLKRYFGKNGVQGNTTKAQLVTALANIPNACEFLRFNLALENSNYVNESTGEILKVISSNFQNEPLYMLWHTVYSLSDKEELKNALNKKYGITDESVLNNLFKIDFIKPGSGNKSAKAIRRILPFLQDGLVYSDACAEAGYNHSNSLTKSENEARTLLSRLPQIKKNELRQPVIEKILNQMVNVVNAIYDEYGQIDEIRVELARELKQSKDERNTTASNIAKRERENKNIEAKIQEFGIRSSRNRIQKYRLWEESEQKCFYCGQPVQAKEFLSGLDVEVEHVIPKSLLFDDSFANKVCACRKCNAAKGNKTAYDFMKGQKEEVFDAYVKRVNDFYKDGKISKTKKERLLTTQSEIPSDFIERQLRQTQYIAKKALEMLKEICYNVYATSGSVTDFIRRTWGYDEILHQLNFDRYKKGGLTELREYEHKGETHTEERIQDWSKRLDHRHHAIDALVIAMTRQSIIQRLNHLNTERDAMFQEVEKQRKDWKN

SEQ ID NO: 1222 - protein, 797 aa, Unknown
  Description of Unknown: uncultivated organism with predicted taxonomy: Bacteroidales
  MG16-141 effector
MKKHILGLDLGVGSIGWALIETEDDQPKQIIGMGSRIVPISKDDSDQFSKGQAISKNADRTARRTTRKGYDRYQLRRALLTQVLRQNGMLPERMDENVIDLWKLRSGAATEGHQLTLPQIGRVLYHINQKRGYKHAKADDNGDSKQTKYVEAVNQRYKEIQEAKQTIGQHFYLELLRSKVESGSGPYYTFRIKDKVFPRAAYIAEFDQIMKVQRAYYPDVLTDELIDTLRNRIIFYQRPLKSCKHLVSLCEFEMKPYKTKDGKIVYGGPKCAPRTSPLAQFCAMWETANNITLTNRNNEQYDFSLEERRQIVEHLCTHEALKLTDLYKILGITKKDGWYGGKAIGKGIKGNATLNQLRKALNGKYGEWLEMPIERVDVVDNETAEVFWQVSPKVEETPLFKLWHAVYSIQDADELAKTLRNKFGIDDQDVIEALCKIDFVKPGYANKSHKFIRRLLPYLMEGMMYSEACARIGINHSNSMTAAERDARPLAERIELLQKNALRQPVIEKILNQMINLVNRLQQEYGPIDEARVELARELKQSREEREGAYRRNNQNERLNKEIAAKIEEMGIRPSRSRIQKYKMWEESNHRCMYCGKTVSLAEFLNGADVEIEHIIPRSILFDDSFSNKVCACRECNHEKGNMTALDYLETKPAAEVEAYKQRVDEAFKEGRISKTKRDHLLWHKSDIPTDFIDRQLRQSQYIAVKAVEILQQGIRQVWTSGGSVTDFLRHQWGYDEILHTLNLPRYRKVEDLTEIVHYEHAGQEHDEERIKNWSKRIDHRHHAIDALTVALTRQAY

SEQ ID NO: 1223 - protein, 1154 aa, Unknown
  Description of Unknown: uncultivated organism with predicted taxonomy: Bacteroidales
  MG16-142 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGSYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKALNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNEHENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMKIKSVRCYTSLSENGVVPVKFDEKGQPIGFAKKGNNHHVAIYQDKDGQYQEMVVSFWDAVERKKYGVPSVITNPRELWNSIMDIDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1224 - protein, 1048 aa, Unknown
  Description of Unknown: uncultivated organism with predicted taxonomy: Deminuibacter soli
  MG16-143 effector
YCDLLQICIGKYDVFFRLFKQMRKILGLDLGVGSIGWSLIETDANDNPVAILGIGSRIVPLSTDDANEFSSGNAISKNQKRTQKRTQRKGYDRYQLRRALLTEKLRESGMLPDERLIKLPVLDLWQLRANAATPGKQLELKEIGRVLYHINQKRGYRHSRYDDGDEKSQREYVQQVNQRFRDIRDEGVTIGQHFANKLAENEVTTPKGKFYTYRIKEQVFPREAYVEEFDRIMDCQRGFYPDILTDSTIGVIRDEIIFYQRPLKSCKHLVSVCEFAMREYKTSDGKSVLSGPKVAPRSSPLFQVCKIWESINNLSLKNRSGQVYRFSDEDRQKMFDFLDNHDRMTVTDLYKLLSISKKDGWWGGKAIGKGLQGNTTKAALAKVLGSRSELLRFQLETIDSKRIDTETGEILKVISPSFEKEPLYRLWHIVYSMHERSEVAAALERQFGITDPETVDKLFSIDFIKAGYGNKSARFIREILPYLQVGMQYSDACNYIGINHSNSLTTEDNASRVLLDKLPQLKKNELRQPVIEKILNQMVAVVNALLSQFGPIDEIRVELARELKQSRDERNDAFLKNNKRERENKVIEERIREYGITPSRSRIQKYRLWEESNHLCFYCGQPVGAAEFLSGSGVEIEHIIPRSLLFDDSYANKVCSCRKCNAEKGNSTAYDYMKAKPEGDFEDYLKRIEKFFSEKRISKSKREKLLTPASEIPQDFIDRQLRQSQYIAKKAVDMLKQVCRNVWTTSGSVTDFLRHNWGYDQILHDLNLPRYKEGGMTEMVHYEHNGQEHDEERIIGWTKRLDHRHHAIDALTIASTRQSYIQRLNTLYASRDAMHAEIKKQSAHWQEKHSLLEEWTKQRPHLPVSVVRDSVDGILVSFKPGKRVATPGKRYTYKGKKELIQDGLLIPRGALSEESVYGQITTLEEHVPVKRLFEDPSLIFKPYIRHLVEQRIEEFHGDWKKARLSIGKKPIWLDEGETVALEYATCWKKEYVIRYPVSSLKAKDVNSIVDRHIREIVRKRIDEVGEKDAFKTPLFSDATQMIPVNGIR

SEQ ID NO: 1225 - protein, 1244 aa, Unknown
  Description of Unknown: uncultivated organism with predicted taxonomy: Bacteroidales
  MG16-144 effector
MKRILGLDLGTTSIGWAVINVDDNLKPVSIESMGSRIVPLSSDDTNEFTKGNAISKNQSRTERRTSRKRYDRYQLRRKYLTAELRKLKMLPDERLIKLPTLELWELRANAASKGHQLTLPELGRVLYHINQKRGYKHAKSDDSSDTKQKAYVAEVNARYSMIKEKNQTIGQYFAEKLKESEVVTPKGKFYTYRTKEQVFPRKAYEAEFDQIMECQKVFYPNLLTEKEISKLRNEIIFYQRNLKSCKHLVSVCDFEKKEYKNKEGKIVFGGPKVAPKSSPLFQICKIWEEVNNLTLKNRKNEELYISLEQRQAMVDFLDTHEKMTLNDMYTILGISKKDGWWGGKAIGRGLQGNTTKIALMNALGNSENVKSLFQFNLHKIDSQLVDEVTGEIIQIIDPKLEKEPLYDLWHTIYSISDKEEFAKALKKKYNITDETIINGLYSIDFVKPGFGNKSAKSIRRILPYLQEGLKYSDACEYAGFRHSESLSKAENETRTLLDELPHINKNELRQPIVEKILNQMINVVNALMNEYGKFDSIRVELARELKQSKDERNTTFLQNEAMQRLNESIAKRLVSENINPTKRIIDKYKFIFPTKGCFDKRTGKFITKNFESLSTVNRCIYCGQSFSLSEALNGDGYEIEHILPRDLICDNSQNNKVLSCRKCNSIKSNKTAFDYMRTQDKNAFEAYLERVESWYKDGIISPAKRERLLLSHEDYLERKRIGKETDEDKKYWEEFVSRQAGETQYISRESIRILKQCCRNVNATSGSITATLRHLWGYDEVLHQLNFERFKNAGLTETVTWESNHGKNKHSKEQIIDWSKRVDHRHHAIDALVVACTQQGFIQRINTLNADETKDLMKRQIETVGVKYDEKKILLDKYLTSLAPFKTQTVANAASNILVSFKPGKKTATTGKRIEYRNGKKHVVQKGIIIPRGALHEEGVYGEIEINGKKHIVKKYKLGKGAQGFVFTGKETYTEKINKKTGEIQIEDKIKNVLDSIVDGSIRAKVLQRLNQGFEEGKDYRNDVKKALENLNDLDKNPIYADDNNTIPIRTVRCITGLSAIVPIKYNDQGKSIGFVKPGNNHHIAIYQDNEGNLREHSVTFWHAVERKKYGVPVIIDNPIQVWDSIKDRQLPESFLEKLPEVNWTYKISLQQNEMFILGMEDDAYDYAIRNQDYSTLGQYLYKVQNVSEKQYRFSLHNMTKFDIKRMNKADKCFYNIQSIDALFRLHPHKVHISLIGKIKEIQE

SEQ ID NO: 1226 - protein, 1266 aa, Unknown
  Description of Unknown: uncultivated organism with predicted taxonomy: Bacteroides
  MG16-145 effector
PFTQIFLYFFAIFAKNKKQIIQYTMKKILGLDLGTNSIGWAVVNAEENWKPVSIESMGSRIIPLSSDDTNEFTKGNAITKNQSRTEKRTARKRYDRYQLRREYLTATLRKLKMLPDESLIKLPILELWELRGKAACKGQQLSLPELGRVLYHINQKRGYKHAKSDESSDTKQKAYVAEVNARYAMIKKRNQTIGQYFAEKLKESEIETPKGKFYTYRTKEQVFPRKAYEAEFDQIMACQKVFYPDILTEKEINKLRNEIIFYQRRLKSCKHLVSICDFEKQEYKNKEGKIVFGGPKVAPKSSPLFQICKIWEEVNNLTLKNRKNDELFISLEQRQAMVDFLETHEKLTLSDMYAILGISKKDGWWGGKAIGRGLQGNTTKIALKKALGDFENAERLLQFNLYKTDSNLVDDTTGEIIQIIDSKLEKEPLYDLWHTIYSISDKEEFGKALKRKYNITDEDIINRLYSIDFVKPGFGNKSTKAMRRILPYLQEGLKYSDACEYAGFKHSESLTKSENEARPLLDMLPSINKNELRQPIVEKILNQMINVVNALMNEYGKFDSIRVELARELKQSKDERNTTFLQNEAMQRLNESITKRLESENIKPTKRIIEKYKFIFPTKGCFDKRTGKFITKNFEDLSTINYCIYCGQPFSLSAALNGDGYEVEHILPRDLICDNSQNNKVLSCRRCNSIKSNKTAFDFMRSQEKNAFEAYLERVETWYQDGIISPGKRERLLLSHEDYLERKRLGKETDEDKKYWEEFVSRQARETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKRTATTGKRIEYKEGKRHIVQKGIIIPRGPLHEEGVYGSIKINGEKQIVKKYKLGKGAQGFVFTGKETYEEKVNKKTGEIQIEDKIKNVLDSIVDGNIRTKVLQRLNQGFEEGKDYRNDVKKALENLNNLDKNPIYADDNKTIPIHTVRCITGLSAIVPIKYNNQGKPIGFVKPGNNHHIAIYQDEEGNLKEHSVTFWHAVERKKYGIPVIIENPTKLWDEIKDKQLPESFLEKLPEVNWTFKVSLQQNEMFILGMEDDTYDVAMGNKDFTLISKFLYRVQSISESDYWFRLHIESQNDKTPQAKQAKKFHRIKSLKGFYQLHPHKVHISVIGKIKEL

SEQ ID NO: 1227 - protein, 1218 aa, Unknown
  Description of Unknown: uncultivated organism with predicted taxonomy: Bacteroidetes
  MG16-146 effector
MKKILGLDLGVGSIGWSVIQADEEGNPASLLDIGCRIVPLSTDDANEFSSGNAISKNQMRTQKRTTRKGYDRYQLRRQYLTEELRKLGMLPNERLIKLPVLDLWQLRAYAATPGKKLSLPEIGRVLYHINQKRGYQHSKSDDSDDKSQRDYVQTINNRFATIKTEKKTIGQFFVERLAESEVLTDKGKFYTFRIKEQVFPRKAYVEEFDQIISCQKVYYPDILTDDEIHILRDEIIFYQRPLKSCKHLISRCKFALREYKTADGESIIAGPNVAPRTSPLFQVCKIWESVNNIELKNRDGDSYQFSMEDRQKLFDFLDNNEKLTVTDLKKVLGLNSKDKWWGGKAIGKGLQGNTTKIAIKKALQGHLELLSFNLKSIDSQHIDTQTGEILHEISPDFEKEPLYRLWHIVYSMADPEEMGAAIKRQFGIEDPEILSRLSKIDFVKAGYGNKSARFIRQILPYLQKGLKYSEACDYISINHSNSLTTAENNARKLLSHIPQLQKNELRQPVIEKILNQMVNVVNALIDKHGGIDEVRVELARELKQSKDERNSTFLNNNKRERENKIIEERIAEMGIRPSRSRILKYRLWEEAKHICFYCGQPVGVKEFLEGAEVEIEHIIPRSLFFDDSFANKVCSCRKCNAEKGNRTAFDYMKQKGENEFSDYSRRIEEAFEKKEISKVKRERLLTSAKDIPEDFIDRQLRQSQYISKKAVEMLKQVCRNVWTTSGSVTDFVRHHWGYDNIIHDLNFQRNKNAGQTAIITYEHRGQTHQEERIKEWSKRLDHRHHAIDALTIASTKQSYIQRLNHLNTSRDAMFQELEAQSEEFKEKYSLLERWIKERPHIPVSEVTEAVDGILVSFKAGKRVSTPGKRYTYKKGKRSVAQTGIVVPRGALSEESIYGAISCLEEHVPVKKLFEHPEIIFKSYIREKVENRIREFGGNWKAALQSLKKTPIYLGIDETKPLEYASCWKKEYVIRYPLSSIRKKDVDYIVDQHIRHLVSERIAAVGEKDAFREPLYADKAGKMPIKSVRLFTGLTDSSVSPVKYSHGLPIGFSKPGNNHHYCFYRNRDGELVGHLVSFWHAVERKKYGIPVIIKDTDRLWEEVANRDLPEDFLKNLPPSGLTLEVSLQQNEMFILGMPEEDYQRAIEKSSKNDLNKYLYRVQKISGQYNVFRRNTDTGKEEDSIAQSLGQFIRISSTKGWISYNPHKIHIDILGDICEL

SEQ ID NO: 1228 - protein, 1160 aa, Unknown
  Description of Unknown: uncultivated organism with predicted taxonomy: Bacteroidales
  MG16-147 effector
MKKKILGLDLGVGSIGWALIETEDNQPKQILGMGSRIVPISKDDNDQFSKGQAITKNADRTARRTARKGYNRYQMRRALLTQALRNNNMLPERMDENVIDLWKLRSDAATEGHQLTLPQIGRVLYHINQKRGYKHSKADENGDSKQTKYVEAVNQRFKDIQEAHQTIGQRFYLELLRTRVHREKGDYYTYRIKDQVFPRAAYIAEFDQIMHVQRVYYPEVLTDEFIDTLRNRIIFYQRPLKSCKHLVSLCEFEMRPYKTKDGKIVYGGPKCAPRTSPLAQLCAMWETANNITLTNRNNERFEFTLEQRRQIVDFLCHNKEMKVTHLQKILGISKKDGWYGGKAIGKGIKGNATLNQLRETLQGKYDQWLEMPIKHVDVVDATTSEVFWAVSPEVEETPLFKLWHAVYSLQNADELAKTLREKFQIFDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSREERESAYRAMGQNERRNKEIAEKISEFGIRPSRSRIQKYKMWEESMHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPADFIERQLRQSQYIAVKAVEVLQDGIRHVWTSGGSVTDFLRHQWGYDEILHTLNLPRYRQVEGLTEYVEFEHAGQKHTEERIKNWSKRIDHRHHAIDALTVALTQQGYIQRLNTLEASHDLMEKQVKEAGTHYNEKKSILEKWINEQPHFSVEDVTNVVKGILVSFRAGKRVTTPARRAIYKGGKRVIAQRGIEVPRGALTKDTIYGKQGESYVVKYPLTHQSMKADNIVDPTIRALVKARLAAYNNNANEAFKTPLYSAEGMEIKSVRCVARLTENGVIPIKYNKQGMAIGYAEKGNNHHVAIYKEKDKKTFDITVSFYDAVERKRYGVPVVITNPHEVWDSVLNKDLPQEFLAKLPNDNWQFILSMQENEMFVLGMEDDEFDDAIERQDYATLNKHLYRVQKIAHNDYWFRYHTETTVDDKYGDGEDNKVNLGWSVEMGKVCRIRSCDALFAKHPHKVKVDLLGHIHKA

SEQ ID NO: 1229 - protein, 1154 aa, Unknown
  Description of Unknown: uncultivated organism with predicted taxonomy: Bacteroidales
  MG16-148 effector
MKKKILGLDLGVGSIGWALIETEDNQPKQILGMGSRIVPISKDDGDQFSKGQAITKNADRTARRTARKGYNRYQMRRALLTQALRNNNMLPERMDENVIDLWKLRNDAATEGHQLSLPQIGRVLYHINQKRGYKHSKADENGDSKQTKYVEDVNKRYKDIQEAHQTIGQHFYLELLRSKIERANGPYYTYRIKDQVFPRAAYIAEFDQIMNVQRVYYPEILTDEFIDTLRNRIIFYQRPLKSCKHLVSLCEFEMRPYKAKDGKIVYGGPKCAPRTSPLAQLCAMWETANNITLTNRNNERYEFTLEQRRQIVDFLCHNKEMKVTHLQKILGISKKDGWYGGKAIGKGIKGNATLNQLREALQGKYDQWLEMPIKRIDVVDATTSEVFWAVSPEVEETPLFKLWHAVYSLQNADELTKTLREKFQITDEAVIEALCRIDFVKPGYANKSHKFIRRLLPYLMEGMMYSEACERININHSNSMTREEREQRPLSARIQLLQKNQLRQPVVEKVLNQMINIVNSLKDQYGEIDEARMELARELKQSRDERESAYKAMGQNERRNKEIAAKITEFGIRPSRSRIQKYKMWEESLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKTDIPSDFIERQLRQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEDVTNAVDGILVSFRAGKRVTTPARRAIYKGGKRVIAQRGIEVPRGALTEETIYGKLGDKFTVKYPLDHPSMKPENIVDSTIRELVQKRVAERGKDAFKEPIYSAEGMKIKSVRCFTSLSENGVVPVKYDEAGRPIGYAKKGNNHHIAIYQDKDGQYQEMVVSFWNAVERKRYGVPVVITNPHEVWDSLLNKDLPQEFLAKLPNDNWQFILSMQENEMFVLGMENDEFNDAIERQDYATLNKHLYRVQKLSTHDYSFRYHTETKVDDKYEGAENGRNASMSLGALVPIRSCGSLFVQFPHKVKVDILGHIHKA

SEQ ID NO: 1230 - protein, 1007 aa, Unknown
  Description of Unknown: uncultivated organism with predicted taxonomy: Bacteroidetes
  MG16-149 effector
MKRILGLDLGTNSIGWAVVNTDENDKPVSIERMGSRIVPLTSDDTNEFTKGNAITKNQSRTEKRTARKGYDRYQLRREHLTTELRKLKMLPDEKLIKLPVLELWELRGKAASKGNQLTLSEIGRVLYHINQKRGYKHAKSDESADTKQKAYVAEVNARYAMIKERNQTIGQFFAEKLKENEIETSKGKFYTYRIKEQVFPRKAYEAEFDQIIECQKEFYPDILTNEEINRLRNEIIFYQRRLKSCKHLVSFCDFEKREYINKVGKVVYGGPKVAPKSSPLFQLCKIWEEVNNLTLRNRKNDELFITIEQRQAMVDFLDTHEKLTLSDMYSILGISKQDGWWGGKAIGRGLQGNTTKIALKKALGDFVNADTLLQFNLKQTDSNLVDEVTGEILQVIDPKLEKEPLYDLWHTIYSISDKEELTNALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFDSIRVELARELKQSKDERNVTFLQNEAMQRLNDSIANRLSSEGIKPTKRTIEKYKFIFPTKGCFDKRTGKFITKNFENLSTVNRCIYCGQPFSLSAALNGDGYEVEHILPRDLICDNSQSNKVLSCRKCNSIKSNKTAFDFMRSQGEHAFETYLERVESWYKDGIISPSKRERLLLSHEDYLERKKKGKITDIDKKYWEDFVSRQAGETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKKTATIGKRIEYKHGNKHIVQKGIIIPRGALHEEGVYGRIEINGKKEIVKKYKLGKGAQGFVFTGKETYAEKINKKTGEIQIEDKIKNVLDSIVDGNIRNKVL

SEQ ID NO: 1231 - protein, 1250 aa, Unknown
  Description of Unknown: uncultivated organism with predicted taxonomy: Bacteroidales
  MG16-150 effector
MKRILGLDLGTTSVGWALITVDESNNPIDIQDIGVRIVPLAENEGDKFTKGQDITVNADRTLARGIRRNYDRYQMRRRALTEKMRQLNMLPDEHLIKLPVLDLWQLRANAAKQKISLCELGRVLYHLNQRRGYKHARTDSNDSKQKDYVQKINNRYSLLQQLGLTIGQYFAQKLAETAITHNGKTFYVFRIKEQIYPRRAYEEEFDTIMTCQQLFYPTILTDEVINEIRNNIIYYQRDLRSCKHLVSICEFEKRSFYDENGEVKRNKKGEIVYSGPKVAPRTSPLFQVFKNWQSINNLHFHNRRNEDLFITLEQKTHIASIMDNKELLKLKDVHEVLGINNKSGWYCDKAIKAGIKGNTTKTAIIACLSTLPLSIINEIARFNLKTEKTNIVDEESGEIFVRISNNYQDEPLYRLWHIIYSIKDDEERFNAISKFLKDFGIEDDSITNALKDIDFVTPGYANLSAKAISKILPYMMEGLDYSDACEYVGYNHSDSLTKEENASRDLVDKIPLLKKNELRQPTVEKILNQTINIFNQINADLIQKGERIDEVRVELARELKQSKTEREEASAGIRKQQALNDNYANILKSESIRPTRNKILKYRLWTESNKTCFYCDQPVNFKEYLQTTEFEREHVIPKRLIFDDSFANQVCSCSKCNKEKGGLTALDFMRTKANLRNYLDKVDSMYQKHEISGKKRSHLLASYDDYLERKKEGKETKEDIMIWETPIDRQLRLSQYISRKAMEILRMGCREVVATSGSITELIRHTWGYDTILHELNCPDYKEAGLTEIIIDEKTKRQREVISDWTKRLDHRHHAIDALAVACTTHSIVQHINTLHASRKIMRDEIKTSRKEWKDNYLLQQWIKEKMPFDRHYVLHKIASILVSMKAGKKATVPGKRKIYKNGKPQIIQTGIKIPRGQLHEKTIYGAIKQWSGGEEHRKIVTRYKLGIGAAGYVFNGKESCDVIFDKKKKQYVMDDGIDKAIKYIVDKHIQDVIRGRLNEAFPANETYRSEAEKALAEGKTYDGKDRSKKALEQLRTLSEKPLYADKGKTIIIKSVRCFTGLSAVQPLRYNSQNEPIAFVLTKNNHHVAIYSDEKGEYKECVYTFWQAVERSKYRLPLIIKEPHELWREIMKRENDGEHFPDSIIEALPSPNWTFIESLQLNDMFVMDLDDETFEEYITNKNYEKLGKKLYRVQSLSTGDYCFRHHTDTTTDRTNAKLTKKFLRKSLMSFISSNPRKVQISLLGKINRDC

SEQ ID NO: 1232 - protein, 1242 aa, Unknown
  Description of Unknown: uncultivated organism with predicted taxonomy: Prevotella
  MG16-151 effector
MKKILGLDLGTNSIGWAVVNAEENWKPVSIESMGSRIIPLSSDDTNEFTKGNAITKNQSRTEKRTARKRYDRYQLRREYLTATLRKLKMLPDESLIKLPILELWELRGKAACKGQQLSLPELGRVLYHINQKRGYKHAKSDESSDTKQKAYVAEVNARYAMIKKRNQTIGQYFAEKLKESEIETPKGKFYTYRTKEQVFPRKAYEAEFDQIMACQKVFYPDILTEKEINKLRNEIIFYQRRLKSCKHLVSICDFEKQEYKNKEGKIVFGGPKVAPKSSPLFQICKIWEEVNNLTLKNRKNDELFISLEQRQAMVDFLETHEKLTLSDMYAILGISKKDGWWGGKAIGRGLQGNTTKIALKKALGDFENAERLLQFNLYKTDSNLVDDTTGEIIQIIDSKLEKEPLYDLWHTIYSISDKEEFGKALKRKYNITDEDIINRLYSIDFVKPGFGNKSTKAMRRILPYLQEGLKYSDACEYAGFKHSESLTKSEIEARPLLDMLPSINKNELRQPIVEKILNQMINVVNALMNEYGKFDSIRVELARELKQSKDERNTTFLQNEAMQRLNESITKRLESENIKPTKRIIEKYKFIFPTKGCFDKRTGKFITKNFEDLSTINYCIYCGQPFSLSAALNGDGYEVEHILPRDLICDNSQNNKVLSCRRCNSIKSNKTAFDFMRSQEKNAFEAYLERVETWYQDGIISPGKRERLLLSHEDYLERKRLGKETDEDKKYWEEFVSRQARETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKRTATTGKRIEYKEGKRHIVQKGIIIPRGPLHEEGVYGSIKINGEKQIVKKYKLGKGVQGFVFTGKETYEEKVNKKTGEIQIEDKIKNVLDSIVDGNIRTKVLQRLNQGFEEGKDYRNDVKKALGNLNNLDKNPIYADDNKTIPIHTVRCITGLSAIVPIRCNNQGKPIGFVKPGNNHHIAIYQDEEGNLKEHSVTFWHAVERKKYGIPVIIENPTKLWDEIKDKQLPESFMEKLPEVNWTFKVSLQQNEMFILGMEDDTYDVAMGNKDFTLISKFLYRVQSISESDYWFRLHIESQNDKTPQAKQAKKFHRIQSLKGFYQLHPHKVHISVIGKIKEL

SEQ ID NO: 1233 - protein, 1228 aa, Unknown
  Description of Unknown: uncultivated organism with predicted taxonomy: Fibrobacter
  MG16-152 effector
MKKILGLDLGVGSIGWSVISVDENGDPSEILGMGSRIIPLSTDDANEFSTGNAISKNQKRTQKRTARKGYDRFQLRRENLTAELRKLHMLPDEKLIKLPILELWTLRAKAATEGNKLSLPEIGRILYHINQKRGYKHAKADEAGDKQQTEYVAAVNSRYAMIKERSQTIGQYFAEKIRESEVISEKGKFYTFRTKEQVFPRKAYEEEFDKIIAVQRQYYPDVLTDSAINRLRNEIIFYQRNLKSCKHLVSLCEFEKHEYKNKEGKIVYDGPKVAPRTSPLAQICRIWEFVNNISLENGYKERRELSLEEKQKVVHFLDNNEKMTATDFSKLLGLGKKNEWDLKRYFGQNGVKGNETKVSLRNALKDFPNVEELLQFNLTLDNSNYVNESTGEVLKVISPSFQNEPLYDLWHTVYSLSDKDELSNALGKKFGISDKNAIQQLFKIDFVKPGFSNKSAKAVRRILPFLQQGLMYSEACAEAGYNHSNSLTKTENEARSLLDRLPQIKKNELRQPVVEKILNQMVNVVNAIYDDYGTIDEIRVELARELKQSKDERNTTFNNIAKRERENKGIAERIKNEYGLIPNRNKIEKYRLWEEAEQKCFYCGQTVNVKEFLSGFDVEVEHVIPKSLLFDDSYANKVCACRKCNANKGNKTAFDFMKSQSEDAFNNYVSRVEEYYKNGKISRTKHDRLLTPQSEIPSDFIERQLRQTQYISKKALEMLKEVCRNVYATSGSVTDFIRHTWGYDEILHQLNFDRYKQGGLTEAREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKRVATTGKRIKYEKGQKKVLQEGIVIPRGALSEESVYGKIKVIDPHKPLKFLFENPQTIVSPQIKTAVIDRLSKFGNDVKKAIASIKKEPLTLASDKVINDADCFKEEYVIKYPLEGFKAKDIQFVVDKHIREDVLPKRLAEFDGNEKNAFKDIDKNPIFADANHNIPIKHVRCFTGLSAVVPVKHDDAGKAIGFVKPGNNHHVAIYKDECGKLHESLVSFWNAVERKIKKVPVVITQPQDAWNIAENAHCSEEFTASLPNKTWTFVQSLQVNEMFVLGLEESAYQKAVREKDYNLINKHLYRVQSISKSDYFFRHHLETIIDDTSASKEMKRFYRFKSLGSFFKENPHKVQISVLGKLIVKE

SEQ ID NO: 1234 - protein, 1154 aa, Unknown
  Description of Unknown: uncultivated organism with predicted taxonomy: Bacteroidales
  MG16-153 effector
MKKHILGLDLGVGSIGWALIETEDDQPKQIIGMGSRIVPISKDDSDQFSKGQAISKNADRTARRTTRKGYDRYQLRRALLTKVLRQNRMLPERMDENVIDLWKLRSDAATEGHQLTLPQIGRVLYHINQKRGYKHAKADDNVDSKQTKYVEAVNQRYAEIQEAKQTVGQHFYLELLRSKVESGNGPYYTFRIKDKVFPRAAYIAEFDQIMKVQKVYYPEVLTDEFIDTLRNRIIFYQRPLKSCKHLVSLCEFEMKPYKTKDGKIVYGGPKCAPRTSPLAQLCAMWETVNNITLTNRNNERYEFSLDERKQLVEHLCTHEALKLTDLYKILGITQKDSWYGGKAIGKGIKGNATLNQLRKALNGKYSEWLEMPIERIDAVDDETAEVFWQVSPKVEETPLFKLWHAVYSIQDADELAKTLRNKFGIDDQEVIDALCKIDFVKPGYANKSHKFIRRLLPYLMDGMMYSEACARIGINHSNSMTAVERDARQLSDHIELLQKNALRQPVIEKILNQMINLVNRLQQEYGPIDEARVELARELKQSREEREGAYRRNNQNERLNKEIIAKIEEMGIRPSRSRIQKYKMWEENNHRCMYCGKTVSLAEFLNGADVEIEHIIPRSILFDDSFSNKVCACRECNHEKGNMTALDYIETKPAAEQEAYKQRVDEAFKEGRISKTKRDHLLWHRSEIPTDFIERQLRQSQYIAVKAVEILQQGIRQVWTSGGSVTDFLRHQWGYDEILHTLNLPRYRQVEDLTEMVHYEHAGQEHDEERIKNWSKRIDHRHHAIDALTVALTRQAYIQRLNTLEASHDFMEKQVKEAGTQYNEKKSILEKWILEQPHFSVDDVTQSVDSILVSFRAGKRVTTPARRAIYQGGKRTIVQTGLQVPRGALTEDHIYGKLGDKFVYKYALTDQSMHPENIVDPTIRAIVQKRVAERGKDAFKEPLYSAEGMEIKSVRCYTSLSENGVVPVKQDEHGRNIGYAKKGNNHHVAIYQDKDGQYQEMVVSFWDAVERKKYGVPVVITNPRAVWDSIMDKDMPQEFLEKLPNDDWTYILSMQENEMFVLGMEEDEYNDAIEAKDYAALNKHLYRIQNISSLFYIFRYHTETKVDDKYEGIANGRNASMSLGALIPIRSFKALFAQFPHKVKIDIMGRITRA

SEQ ID NO: 1235 - protein, 1154 aa, Unknown
  Description of Unknown: uncultivated organism with predicted taxonomy: Bacteroidales
  MG16-154 effector
MKKKILGLDLGVGSIGWALIETEDNQPKQILGMGSRIVPISKDDNDQFSKGQAITKNADRTARRTTRKGYNRYQMRRALLTQALRNNNMLPERMDENVIDLWKLRSDAATEGHQLTLPQIGRVLYHINQKRGYKHSKADENGDSKQTKYVEAVNQRFKDIQEAHQTIGQHFYLELLRTRVHRENGDYYTYRIKDQVFPRAAYIAEFDQIMNVQRAYYPEVLTDEFIDTLRNRIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKHIDVVDAATSEVFWAVNPEVEETPLFKLWHAVYSLQNAEELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAAKIAEFGIRPSRSRIQKYKMWEESQHQCFYCGKTIDLSEFLNGADVEIEHIIPRSILFDDSFSNKVCACRRCNQEKGNQTAMEYMETKSAAEQETYKQRVDEAFTAKRISKTKRDHLLWRKADIPADFIERQLRQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEEVTNAVDGILVSFRAGKRVTTPARRAIYKGGKRVIAQRGIEVPRGALTEETIYGKLGDKFTVKYPLDHPSMKPENIVDPTIRALVQKRVAERGKDAFKEPLYSAEGMEIKSVRCFANVTDNSVVPIKYNEEGQPIGYAKKGNNHHVAIYTDKSGKPQESVVSFWDAVERKRYGVPVVITNPHEVWDNLLNTDFPEEFLAKLPEDDWQYLFSMQENEMFVLEMEDDEFYDAIERQDYASLNKHLYRVQKIRSGEYTFRYHTETKVDDKYEGVANGTNTSFQLGALVSIRGFSSLFAKHPHKVKIDLLGHIHKA

SEQ ID NO: 1236 - protein, 1217 aa, Unknown
  Description of Unknown: uncultivated organism with predicted taxonomy: Bacteroidales
  MG16-155 effector
MKRILGLDLGVGSIGWSLIQADDEGNPQSILDIGCRIVPLSPDDTNEFSSGNAISKNRKRTQKRTCRKGYDRYQQRRQNLTDELRGLGMLPDERLIKLPVLDLWQLRADAATPGKKLTLPEIGRILYHINQKRGYLHSKTDEDDKAQRDYVQAINNRFAHIKAEGKTIGQYLAGKLADSEVTTDKGQFYTFRIKEQVFPRKAYQEEFDQIIACQRIHYPDILTEEVIHRLSDEIIFYQRPLKSCKHLISQCEFAMREYKTADGKRIQAGPKVAPRSSPLFQVCKIWESVNNIEMKNRNGESYPFSEEERLKLFNFLDNNEKLTVTDLKRILGLSVKDKWWGGKAIGKGLQGNTTKIALKKALQGHEGLLSFHLKTVDSRHIDTETGVILQEIAPGFEKEPLYRLWHIIYSIKEPDEMASALKQQFGIEDPEVLSRLAKIDFVKAGYGNKSARFIRQILPYLQKGLKYSEACDYISINHSNSLTTAENKSRKLQPRMQQLQKNELRQPIIEKILNQMVNVVNALLDKHVSIDEVRVELARELKQSRDERNSTFLNNSKRERENKIISERIQEMGIRPSRNRIQKYRLWEESKHICFYCGQPVGVREFMEGVDVEIEHIIPRSLFFDDSFSNKVCACRKCNAEKGNRTAYDYVKKKGENEFADYTRRIEEAFEKKEISKTKRERLLTSAKDIPEDFIDRQLRQSQYISKKAVEMLKQVCRNVWTTSGSVTDFVRHQWGYDNILHDLNFKRYKDAGQTEIIVCDQMGQVRQVERIKDWTKRLDHRHHAIDALTIASTKQSYIQRLNHLNASRDQMFQELETQSNKVREEYSLLENWMKERPHIPVSVVSQIVDGILVSFKTGKRLTTPGKRYTYKGGKREIAQSGIIVPRGALSEDSVYGVISCLEENVPVKKLFEHPDIIFKPYIRTKVENRIKEYDGDWKAALKSLKKAPIFLGDGETKPLEYATCWKKEYVIRYPLASIQKKDVKYIVDQHIRQLVSERLNAVGEKDAFKEPLFSDKAEKNPIKSVRLFTGLTHNSLSPVKYLDGFPIGYSKPGNNHHFCYYRNENGELFEHIVSFWHAVDRKKYGIPVIIEDTDVLWDEMANRDLPQDFLKYLPPVGLKLEVSLQQNEMFILGMKDEDYERSIKEKDLRMLNQYLYRVQKISSQYIVFRRNTDTGKDEDSKAQSIGQFVRVSSIKGWIQCNPHKIRVNVLGEISEI

SEQ ID NO: 1237 - protein, 1154 aa, Unknown
  Description of Unknown: uncultivated organism with predicted taxonomy: Bacteroidales
  MG16-156 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGPYYTFRIKDKVFPRAAYLDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKAMNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNERENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDKDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1238 - protein, 1223 aa, Unknown
  Description of Unknown: uncultivated organism with predicted taxonomy: Fibrobacter
  MG16-157 effector
MKKILGLDLGVSSIGWSVISVDDNGDPSDILGMGSRIVPLSTDDANEFSTGNAISKNQKRTQKRTARKGYDRYQLRRENLTVELRKHKMLPDEHLIKLPVLKLWTLRASAATEGHQLTLPEIGRVLYHINQKRGYKHAKADEAGDKKQTDYVAAVNQRFAMIKERGQTIGQYFAEKLKENEVVTEKGKFYTYRTKEQVFPRGAYIAEFDQIITVQRKFYPQILTEEFINRLRNEIIFYQRNLKSCKHLVSICEFEKHEYKNKEGKTVFDGPKVAPRTSPLFQICRIWEFVNNIRLENGYKEARELTQEERLKVVEFLDNHEKMTAKDFSKLLKLNKDNEWDLKKYFGKNGIQGNTTKTKLATAIANVPNANDLLRFDLTLENSNFVNEATGEVLKVISSDFQNEPLYMLWHTVYSLSDKDELKSSLEKKYHITDESIVDNLFRIDFIKPGFGNKSAKAIRRILPFLQEGLVYSEACAEAGYNHSNSLTKTENEARTLLARLPQIKRNELRQPVIEKILNQMVNVVNAIYDEYGQIDEIRVELARELKQSKDERKATAANIAKRERENKAIAAKIEEFGIRPSRNRIQKYRLWEESEQKCFYCGQPVDAREFLSGLDVEVEHIIPKSLLFDDSFANKVCACRKCNAAKGNRTAFDYMKSQSSNAFDAYIKRVNDFYKDGKISKTKNERLLTTQSEIPSDFIERQLRQTQYIAKKALEMLKEVCYNVYATSGSVTDFIRHTWGYDEILHQLNFDRYKKGGLTELREFDHKGATHTEERIQNWSKRLDHRHHAIDALVIAMTRQSIIQRLNHLNTERDAMFQEVEKQSKEWKNDYSLLQEWLRERKHFSTDEVAQKVSDILASFKAGKRVATIGKRIKYEQGKKKALQTGIVIPRGPLSEESVYGKIKVLDPSKPIKFLFENPQSIISAEIRTAITNRLSKFENDIKKAIQSLKDDPIILANGKNLETADCYKEEYVIKYSLNGFKAKDIESVVDGHIKEILYKRLEEFNGNEKEAFKDIENKPIFADSAHKIPIRNVRCFTGLSAVVPVKQDNNGNNIGFVKPGNNHHIAIYKDENGNLQESVVTFWHAVERKKYGLPIIITNPAEVWEIAKAKDCPSEFLACLPNEKWSFVQSLQINEMFIMGLDDETYEKTLSEHNYTLINQHLYRVQKLTSNDYFLRFHLETKIDDSAEAKQMGKVLRKSLKTFIQDNPHKVKVSVLGKLIT

SEQ ID NO: 1239 - protein, 1217 aa, Unknown
  Description of Unknown: uncultivated organism with predicted taxonomy: Bacteroidetes
  MG16-158 effector
MRKILGLDLGVGSIGWSLIETDTKDNPVAILGMGSRIVPLSTDDSNEFSSGNAISKNQKRTQKRTQRKGYDRYQLRRALLTEKMRELGMLSDERLIKLPVLELWQLRANAATPGKQLELKEIGRVLYHINQKRGYKHSRSDDGDEKSQREYVQQVNQRFRDIRDEGLTIGQHFANKLAENEVITPKGKFYTYRIKEQVFPREAYIEEFDRIMDCQQVFYPDILTDTIIREIRNEIIFYQRPLKSCKHLVSVCEFAMREYKTSDGKSILSGPKVAPRSSPLFQVCKIWESVNNLTLKNRSGQVYHFSDEQRQRMFDFLDNHERMTVTDLYKLLNISKKDGWWGGKSIGKGLQGNITKAALAKALSNHRDLLRFQLETIDSKRIDTETGEILKVISSSFEKEPLYSLWHIVYSMHERSEVAAALERQFGITDPDTIDRLFAIDFIKAGYGNKSARFIREILPYLQAGMQYSDACNYIGINHSNSLTTEENANRALLDKLPQLKKNELRQPVIEKILNQMVAVVNALLSRFGPIDEIRVELARELKQSRDERNNAFLNNNKRERENKVLEERIREYGISPSRSRIQKYRLWEESNHLCFYCGQPVGAAEFLSGSGVEIEHIIPRSLLFDDSYANKVCSCRKCNAEKGNSTAYDYMKAKPEGDFEDYLKRIETFFSEKRISKAKRDKLLTPATDIPQDFIDRQLRQSQYISRKAVDMLKLVCRNVWTTSGSVTDFLRHNWGYDQILHDLNLPRYKEGGMTEVVHYEHNGQEHDEERIIGWTKRMDHRHHAIDALTIACTRQSYIQRLNTLNASRDAMHAEIEKQNAYWQEKHSLLEEWTRQRPHLPVSVVRDYVDGILVSFKPGKKVATPGKRYTYNGKKELAQDGLLIPRGALSEESVYGQITSIVEHVPVKRLFEDTSLIFKPYIRNLVEQRIEEYHGDWKKARLSIGKKPIWLDKGETIALEYATCWKKEYVIRYPVSSLREKDVDSIVDRHIREIVQKRIDEVGEKDAFKTPLFYDAAQKIPIKSIRCFTGLDAVEAVKYANGIPIGFSKPGNNHHIAIYRDKEGNRFEHVVSFWHAVERKRFGLPVIIQDTDSVGDQIQGISLPESFLKNLPAPGATLELSLQQNEMFILGMKEDEFNDAIREKDNTALNKHLYRVQKLGSLYYVFRYHTETQIDDSNNAIIMHKFYRCRSLSAFDALNPHKVRVSITGEIMQGDD

SEQ ID NO: 1240 - protein, 971 aa, Unknown
  Description of Unknown: uncultivated organism with predicted taxonomy: Bacteroidetes
  MG16-159 effector
MKKVLGLDLGVGSIGWCLIEKDDDNTPKRIIRMGSRIVPISSDEESGYTRGNAISKNADRTAKRTSRKCYDRYQLRRQALLNLLKRLGMEPSKKLIFEQNPLELWQKRADAASKEITIEELGRVLLHINQKRGYKHSRLSNSDSKETAYVQEVNSRYDDLKAEGLTIGQHFAAKLKENEQTSADGKKYYTYRIKEQVYPRHAYEEETEQILEVQSRYHADILTPDVCKEIKDIIFYQRDLKSCKNLVSLCEFESYTITKDGKEMTIGPKVAPRTSPLAQLSSILETANNITIRNRRNDELYISPEQRKAIADFLDNHEVMKLTDLYKILNIGRKDGWWAGKAIGKGLKGNTTKCQIREALSNLSKEQIESLTAFKLEYDEYVDAETGEVRKRINNTLAEKQPLYRLWHLLYSIKDVDELSGALRRLGIENEESIQNLCNLDFRTAGYANKSAKAIGRILPYLMDGMMYSDACELAGFDHSRRINPDRVLLTSLPQIQKNELRQPVVEKILNQLVNVVNALLEKEGPIDESRVELARELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMSRKAQGKETEEDKELWENFIDRQLRQSQYIARKSVEMLQQVCKNVYSTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTRITVPGKRYITKNGKRALVQTGIIVPRGALHAEFVYGRIMKQEADGVTLTPQYVRKYKLGIGAQGFLFNGKEFYKEELKRDSKTGLSSIVVTDKIK

SEQ ID NO: 1241 - protein, 1051 aa, Unknown
  Description of Unknown: uncultivated organism with predicted taxonomy: Fibrobacter
  MG16-160 effector
MKKILGLDLGVSSIGWSVISVDENGDPSEILGMGSRIVPLSTDDANEFSTGNAISKNQKRTQKRTTRKGYDRYQLRRENLTAELRKHQMLPDEHLIKLPVLDLWTLRANAATEGHQLSLPEIGRVLYHINQKRGYKHAKADEAGDKKQTEYVENVNKRFAMIKELGLTIGQFFANKLKESEVISEKGTFYTYRTKEQVFPRGAYIAEFDQIIEVQRKFYPQVLTDEFINRLRNEIIFYQRNLKSCKHLVSLCEFEKHEYKNKDGKIVFDGPKVAPRTSPLFQICRIWEFVNNIRLDGYKETKALSQDERLKVVDFLDNHEKMTAKDFIKLLGLDKNDEWDLKRYFGKNGVQGNSTKTQLAAALANIPNTSELLRFNLALENSNYVNKSTGEVLKVISSDFQNEPLYMLWHTVYSISDKEELKNALNKKYGITDESVINSLFKIDFVKPGFGNKSAKAIRRILPFLQEGLVYSDACAEAGYNHSDSLTKSENEARTLLARLPQIKKNELRKPVIEKILNQMVNVVNAIYDEYGQIDEIRVELARELKQSKDERNTTASNIAKRERENEKIEAKIQEFGIRSSRNRIQKYRLWEESEQKCFYCGDTVNVKEFLSGLDVEVEHVIPKSLLFDDSFANKVCACRKCNAAKGNKTAYDFMEGQKKEVFDAYVKRVNDFYKDGKISKTKKERLLTTQSKIPSDFIERQLRQTQYIAKKALEMLKNVCYNVYATSGSITDFIRHIWGYDEILHQLNFERYKKGGLTEFREYDHKGETHTEERIQNWSKRLDHRHHAIDALVIAMTRQSIIQRLNHLNTERDAMFQEVEKQSKEWKNDYSMLQEWLRERKHFSTEDVAKKVSNILVSFKAGKRVATIGKRVKYEHEKKFILQTGIVIPRGPLSEESVYGKIKVLDRNKPLKYLFENPQFIANADIKSAVTNRLIQHENDVKKAVLSLKKSPIVLANGKTLETADCYKEEYVIKYSLNGFKAKDIDSVVDTHIKDVLYKRLEEYDGNEKEAFKDIENNPIYADATHKIKIRNVRCFTGLSAVVPVKKDEN

SEQ ID NO: 1242 - protein, 1153 aa, Unknown
  Description of Unknown: uncultivated organism with predicted taxonomy: Bacteroidales
  MG16-161 effector
MKKNILGLDLGVGSIGWALIETEDDQPKQIIGMGSRIVPISKDDSDQFSKGQAISKNADRTARRTTRKGYDRYQLRRAMLTETLRHNGMLPERMDENVIDLWKLRSDAATEGHQLTLPQIGRVLYHINQKRGYKHAKADDNGDSKQTKYVEAVNQRYVEIQETHQTIGQHFYLELLRSKVESGNGPYYTFRIKDKVFPRAAYIAEFDQIMNVQKAYYPEVLTDELIETLRNRIIFYQRPLKSCKHLVSLCEFEMRPYKTKEGKIVYGGPKCAPRTSPLAQLCAMWEAANNITLTNRNNERYNFSLEERKQIVEHLCSHEALKLTDLYKILGITKKDGWYGGKAIGKGIKGNSTLNQLRKALNGKYGEWLEMPIEHMDVVDEETAEVLWQVSPQVEETPLFKLWHAVYSLQDADELAKTLRNKFNITDQDVIDALCKIDFVKPGYANKSHKFIRRLLPYLIEGMMYSEACARIYINHSNSMTVAERDARPLAEHIELLQKNALRQPVIEKILNQMINLVNRLQQEYGPIDEARVELARELKQSREERENAYKRNNQNERLNKEIAAKIEEMGIRPSRSRIQKYKMWEESDHRCMYCGKMVSLAEFLNGADVEIEHIIPRSILFDDSYSNKVCACRDCNREKDNLTALDYLETKTGAELEAYKQRVDDAFKEGRISKTKRDHLLWRREDIPSDFIERQLRQSQYIAVKAVEILQQGIRKVWTSGGSVTDFLRHQWGYDEVLHTLNLPRYHKVEGMTEFVQYEHAGQTHEEERIKNWTKRVDHRHHAIDALTVALTRQAYIQRLNTLEASHDLMEKQVKDAGTLYNEKKSILEKWINEQPHFSVDEVTRQVDGILISFRAGKRVTTPARRAIYKGGKRIIVQTGLQVPRGALTEETVYGKLGDKFVVKYPLAHPSMKSENIVDPTIRAIVQKRIDERGKEAFKEPLYSAEGMEIKSVRCYTSLSENGVVPVKQDGQGNNIGFAKKGNNHHVAIYQDKNGQYQEMVVSFWDAVERKKYGIPVVITNPHAVWDSVLDKESPQEFLEKLPNDDWKYILSMQENEMFVLGMEDGDFEHAIETQNYAALNKHLYRVQKVSSKFWCFRYHTETMVDDKYGDTKNEQWSFQMGKAFRASSFDGLFRQFPHKVKIDIMGRITKA

SEQ ID NO: 1243 - protein, 1224 aa, Unknown
  Description of Unknown: uncultivated organism with predicted taxonomy: Prevotella
  MG16-162 effector
MKKVLGLDLGTNSIGWCLIEKSDDNIPQRILRMGSRIVPISSDEESGYTKGNAVSKNAERTHKRTARKCYDRYQLRRQALMSLLKRLGMEPSNELIFEQTPMKIWQTRADAATKKISLPELGRVLLHINQKRGYKHSRLNNFDAKETSYVQEVNSRYDELKAEGLTVGQHFALKLKKNEKTSANGRKYYTYRIKEQVYPRHAYEEEARIILNTQRIFYSDILTEDVCKEFLDTIFYQRDLKSCKNLVSLCEFESYTIKKDGKEITIGPKVCPRTSPLAQLSSILETANNITIRNKRNDELYISPEQRQAIADFLDNNEVMKLTNLYNILHIGKKDGWWAGKAIGKGLKGNTTKMQIRAALSNLPSEQVNMLLKFELEFEDYVDKETGEVRQRVDNTQVEKQPLYRLWHLIYSIKDEDELSNALRRMDIKDEETIRKLCSLDFRSAGYAKKSAKAIGRILPYLMEGMMYSQACEQAGFDHSRRVDPGRTLLSALPQIQKNEFRQPVVEKILQQLVNIINSLISKEGTIDEIRVELARELKQSKDERNEAFKRNNQNEKKNKEYAEHIKEYQLTPTRNRLLKWKLYEESDHACMYCGQPIKVREFLQGADVEREHIIPKGLLFDNSFTNQVCSCRSCNSKKGMRTAYDFIEAEKGEEGLRSYIEHINYLFDKKNISRSKYNRLLVSYKAYLQRKVQGKETEEDKNLWENFIDRQLRQSQYIARKAIEMLQQICKNVYSTSGRVTDFVRHQWGYDEILHDLNFDRYKKAGLTTMVTQLQSGDEVEVERIKDWTKRLDNRHHAVDALAIACTTQGMIQRLNTLNASRDEMQAELNDKNGSIMDPNRSMLEKWVSIQPHITYAEAKNEVDKIIISQRPNTRITVPGKRYIQKNGKRTPVQTGIIVPRGALHAEFVYGRIMKQKPTSDGVVKIPQYVRKYKLGIGAQGYLFNGKEFYKEELKKDPRTGLSTIAVTDKINDVLEKIVDGGIRKRILERLNRGFEDGKDYRSNVPRALANLKNLDDDPIYSDDAKTRPILSVRKEVVSTTMVIVRNDRNGRPLAFAEPDGNHHVAFYKNENGLIEERIVTKWHAVQRKLHHVPIIIDNPSATWSDMLGRTDVPEEILKELPKDNSIFMLSLQIGEAFVMGMEESDYQKAIEEGNKQVLAEHLYFVQNLSSSNYRLRRHVESSYDITGMNKEDQRFLNIKSIGALFNYNPHKVKITVLGDIIP

SEQ ID NO: 1244 - protein, 1261 aa, Unknown
  Description of Unknown: uncultivated organism with predicted taxonomy: Bacteroides
  MG16-163 effector
FLYFFAIFAKNKKQIIQYTMKKILGLDLGTNSIGWAVVNAEENWKPVSIESMGSRIIPLSSDDTNEFTKGNAITKNQSRTEKRTARKRYDRYQLRREYLTATLRKLKMLPDESLIKLPILELWELRGKAACKGQQLSLPELGRVLYHINQKRGYKHAKSDESSDTKQKAYVAEVNARYAMIKKRNQTIGQYFAEKLKESEIETPKGKFYTYRTKEQVFPRKAYEAEFDQIMACQKVFYPDILTEKEINKLRNEIIFYQRRLKSCKHLVSICDFEKQEYKNKEGKIVFGGPKVAPKSSPLFQICKIWEEVNNLTLKNRKNDELFISLEQRQAMVDFLETHEKLTLSDMYAILGISKKDGWWGGKAIGRGLQGNTTKIALKKALGDFENAERLLQFNLYKTDSNLVDDTTGEIIQIIDSKLEKEPLYDLWHTIYSISDKEEFGKALKRKYNITDEDIINRLYSIDFVKPGFGNKSTKAMRRILPYLQEGLKYSDACEYAGFKHSESLTKSENEARPLLDMLPSINKNELRQPIVEKILNQMINVVNALMNEYGKFDSIRVELARELKQSKDERNTTFLQNEAMQRLNESITKRLESENIKPTKRIIEKYKFIFPTKGCFDKRTGKFITKNFEDLSTINYCIYCGQPFSLSAALNGDGYEVEHILPRDLICDNSQNNKVLSCRRCNSIKSNKTAFDFMRSQEKNAFEAYLERVETWYQDGIISPGKRERLLLSHEDYLERKRLGKETDEDKKYWEEFVSRQARETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKRTATTGKRIEYKEGKRHIVQKGIIIPRGPLHEEGVYGSIKINGEKQIVKKYKLGKGAQGFVFTGKETYEEKVNKKTGEIQIEDKIKNVLDSIVDGNIRTKVLQRLNQGFEEGKDYRNDVKKALENLNNLDKNPIYADDNKTIPIHTVRCITGLSAIVPIKYNNQGKPIGFVKPGNNHHIAIYQDEEGNLKEHSVTFWHAVERKKYGIPVIIENPTKLWDEIKDKQLPESFLEKLPEVNWTFKVSLQQNEMFILGMEDDTYDVAMGNKDFTLISKFLYRVQSISESDYWFRLHIESQNDKTPQAKQAKKFHRIKSLKGFYQLHPHKVHISVIGKIKEL

SEQ ID NO: 1245 - protein, 1222 aa, Unknown
  Description of Unknown: uncultivated organism with predicted taxonomy: Prevotella
  MG16-164 effector
MKKVLGLDLGVGSIGWCLVEKDDKNIPLRIIRMGSRIVPITKEEENGYTRGNAISKNADRTVKRTARKCYDRYQLRRKALVNLLKRCGMMPDKGLILEQSPLDLWQKRADAASKEISLEEVGRVLLHINQKRGYKHSRLSNSDKKETAYVQEVNSRYDKLKAEGLTVGQHFAAKLKENEQISADGKKYYNYRIKEQVYPRHAYEEEAKRILEVQSQFHTDVLTTNVCKEIFDTIFYQRDLKSCKNLVSFCEFESYTIKRNGKDITIGPKVAPRTSPLAQLSSILETANNITIRNRRNDELYISPEQRQAIANFLDNNEVMKLTDLYKILNIGRKDGWWAGKAIGKGLKGNTTKCQIRKALSKLSQEQIDKLTSFNLIFDEYVDEETGELRKRINNSHAEHQPLYRLWHLIYSIKDNDELSIALRSLGIEDEECIHNLCNLDFRTAGYANKSAKAIGRILPYLMEGMMYSEACNRAGFDHSRRVNPERELLTSLPQIQKNELRQPIVEKILNQLVNVVNALLEKEGTIDEIRVELARELKQSKDERNETYRRNNQNEKKNKEYAERIKKYELTPTRNRIMKMKMLEESEYKCMYCGQPVKEKEFLQGADVEREHIIPRALLFDNSFTNQVCSCRSCNSQKGMRTAYDFIADDKGQEGLEAYIERINDLFNKKKISRSKLNRLLVSYKAYVSRKAQGKETEEDVQLWENFIDRQLRQSQYIAKKSVEILQQVCKNVYTTSGSVTDFVRHQWGYDEILHDLNFERFKKANLTTMVKQLHSGKEVEVERIKDWTKRLDNRHHAVDALAIACTTQGMIQRLNTLNASRDAMLDELNNKEQRMIDSERSMLEKWIISQPHVSCVEAKKEIDKILISLRPNTRITVPGKRYITKNGKRTLVQTGIIVPRGALHAEFVYGRIMKQEADGVTLTPQYVRKYKLGIGTQGYIFNGNETYKEELKKDKKTGLSQIVVTDKIKDVLDKIVDGGIRKRILERLNRGFEDGTDYRTNTAKALENLKNLDEDPIYSDDAKTRPIRTVRKYVNSSTMVAVRKDDNGKPVSFVVPDDNHHVAFYKDKDGVITESIVTKWQAVQRKLKHIPVIVDNPTQTWNDLVGRNDVPEELLQSLPKDNSEFLLSLQIGEAFIMGMEDADFHRAIEEKDIHNLAEHLYFVQNISSNNYRMRRHVEASFDTSDMNKEDQRFLNVSSIGAFFNYNPHKVKVTILGDIIK

SEQ ID NO: 1246 - protein, 1159 aa, Unknown
  Description of Unknown: uncultivated organism
  MG16-165 effector
MKKHILGLDLGVGSIGWALIETEDDQPKQIIGMGSRIVPISKDDSDQFSKGQAISKNADRTARRTTRKGYDRYQLRRALLTQVLRQNGMLPERMDENVIDLWKLRSDAATEGHQLTLPQIGRVLYHMNQKRGYKHAKADDNGDSKQTKYVEAVNQRYAEIKEARQTIGQHFYLELLRSKVESGNGPYYTFRIKDKVFPRAAYIAEFDQIMQVQRAYYPEVLTDELIDTLRNRIIFYQRPLKSCKHLVSLCEFEMKPYKTKDGKIVYGGPKCAPRTSPLAQFCAMWETANNITLTNRNNEQYDFSLEERRQLVEHLCTHEVLKLTDLYKILGITKKDGWYGGKAIGKGIKGNATLNQLRKALNGKYSDWLEMPIERIDAVDNETAEVFWQVSPKVEETPLFKLWHAVYSIQDAEELAKTLRNKFGIDDQDVIEALCKIDFVKPGYANKSHKFIRRLLPYLMEGMMYSEACARIGINHSNSMTAAERDARPLAERIELLQKNALRQPVIEKILNQMINLVNRLQQEYGPIDEARVELARELKQSREEREGAYRRNNQNERLNKEIAAKIEEMGIRPSRSRIQKYKMWEESNHRCMYCGKTVSLAEFLNGADVEIEHIIPRSILFDDSFSNKVCACRECNHEKGNMTALDYLETKPATEVEAYKQRVDEAFKEGQISKTKRDHLLWHRSDIPTDFIDRQLRQSQYIAVKAVEILQQGIRQVWTSGGSVTDFLRHQWGYDEILHTLNLPRYRQVEDLTEIVHYEHAGQEHDEERIKNWSKRIDHRHHAIDALTVALTRQAYIKRLNSLNAEFTREEMLKEVEEANTVYNEKKSLLEKWILEQPHFSVDDVTNSVDSILVSFRAGKRVTTPARRAIYQGGKRTIVQRGLQVPRGALTEETIYGKLGDKFVVKYPLDHPSMKPENIVDPTIRALVQKRVAERGKDAFKEPLFSAEGMEIKSVRCFTSLSENGVVPVKQDEQGRNIGYAKKGNNHHVAIYKDKDGQYQEMVVSFWDAVERKKYGVPVVITNPHDVWDSIMDKDMPQEFLEKLPKDDWSYLLSMQENEMFVLGMEEDEFNDAIEAKDYATLNKHLYRVQKVARNDYWFRYHTETTVDDKYGEGDESKVNLGWSVEMGKVYRVRSCGALFDLFPHKVKIDIMGRITKA

SEQ ID NO: 1247 - protein, 1092 aa, Unknown
  Description of Unknown: uncultivated organism with predicted taxonomy: Bacteroidales
  MG16-166 effector
MKKVLGLDLGVGSIGWCLIEKEDDNTPKRILRMGTRIVPIGSDEESSYTKGNAFSKNADRTAKRTARKCYDRYQLRRHALVDLLKQLGMEPTHKLIYEQTPLGLWQKRADAASKEITLEELGRVLLHINQKRGYKHSRLDNSKSKETAYVQEVNSRYDQLKDEGLTIGQHFAAKLKENEQTSADGKKYYNYRIKEQVYPRHAYEEEVKKILDVQQQYYADLLTDDVCKEIFNIIFYQRDLKSCKNLVSHCEFESYTITKNGKEITIGPKVAPKTSPLAQLSSILETVNNISIRNRRNDELYISPEQKKALADFLDNNEVMKLTDLYRILNIEKKDGWWAGKAIGKGLKGNTTKCEIRKALGNLTKEQVNSLTAFDLVFEEYVDVETGEVRKRVDNNHAEKQPLYRLWHLIYSIKNEEELKGALRNMGIEDEETLQKLSNLDFRNPGYANKSAKAIGRILPYLMEGMMYSQACEQAGFDHSRRINPERQLLKALPQIQKNELRQPVVEKILQQLVNIVNALLAKEGNIDEIRVELARELKQNREERNEAFKRNAQNEKLNKEYAERIKEYGLTPTRNRIMKMKMWEESENTCMYCGQPVDVVEFLQGADVEREHIIPRGLLFDNSFTNQVCSCRKCNSQKGMRTAYDFIEDEKGQEGLESYIKHINYLFDKKKINRSKLNRLLVSHKAYINRKSLGKETEEDKQLWENFIDRQLRLSQYIAKKSVEMLQQICRNVYVTSGSVTDFVRHQWGYDELLHDLNFERYKKAGLTAMVKQLHSGKEVEVERIKDWTKRLDNRHHAVDALAIACTTQGMIQRLNTLNASRDDMLEELNSKKRVADPNRSMLEKWLYAQPHVSYALAKEELDKIIVSQRPNTRITVPGKRYVTKNGKQTLAQTGIVVPRGALHAEFVYGRIMKQEADGKTLTPQFVRKYKLGIGAQGFLFNGKEFYKEDLKKDAKTGLSTIVVTDKIKEVLDKVVDGGIRRRILDRLNRGFEEGTDYRANVGKALANLKNLDEDPIYSDDAKTRPIRTVRKYVNSSTMVAVRKDKNGRPLSFVEPDGNHHVAFYQDDNGIITESIVTRWQAVQRKLSDIP

SEQ ID NO: 1248 - protein, 1162 aa, Unknown
  Description of Unknown: uncultivated organism with predicted taxonomy: Bacteroidales
  MG16-167 effector
MKTKILGLDLGVGSIGWALIETEDNQPKQILGMGSRIVPISKDDGDQFSKGQAITKNADRTARRTARKGYNRYQMRRALLTQALRNNNMLPERMDENVIDLWKLRSDAATEGHQLTLPQIGRVLYHINQKRGYKHSKADENGDSKQTKYVEEVNRRYKDIQEAHQTIGQHFYLELLRSKIERANGPYYTYRIKDQVFPRAAYIAEFDQIMNVQRIYYPEVLTDEFIDTLRNRIIFYQRPLKSCKHLVSLCEFEARPYKTKDGKIVYGGPKCAPRTSPLAQLCAIWETANNITLTNRNNERFEFTLEQRRQIVDFLCHNKEMKVSHLQKILGISKKDGWYGGKAIGKGIKGNATLNQLRDALQGKYDQWLEMPIKHIDVVDATTSEVFWAVSPDVEETPLFRLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAAKIAEFGIRSSRSRIQKYKMWEESLHQCFYCGKTIDLSEFLNGADVEIEHIIPRSILFDDSFSNKVCACRRCNQEKGNQTAMEYMETKSASEQEAYKQRVDEAFTTKRISLTKRDHLLWHKADIPSDFIDRQERLSQYIAVKAVDLLQQGIRQVWASSGTVTFFMRHQWGYDEILHTLNLPRYRRVEGMTEFVDFEHAGQKHTEERIKNWSKRIDHRHHAIDALTIALTRQAYIQSLNTLSSEITREEMIEIIKETGKVYKEKTSLLDKWARELPHFSVEDVTNAVDGILVSFRAGKRVTTPARRAIYKGGKRVIAQRGIEVPRGALTKDTIYGKQGESYVVKYPLTHQSMKADNIVDPTIRALVKARLAAYNNNANEAFKTPLYSAEGMEIKSVRCVARLTENGVIPIKYNKQGMAIGYAEKGNNHHVAIYKEKDKKTFDITVSFYDAVERKRYGVPVVITNPHEVWDSVLNKDLPQEFLAKLPNDNWQFILSMQENEMFVLGMEDDEFDDAIERQDYATLNKHLYRVQKIAHNDYWFRYHTETTVDDKYGDGEDNKVNLGWSVEMGKVCRIRSCDALFAKHPHKVKVDLLGHIHKA

SEQ ID NO: 1249 - protein, 901 aa, Unknown
  Description of Unknown: uncultivated organism with predicted taxonomy: Barnesiella viscericola
  MG16-168 effector
MKNILGLDLGTTSVGWALIKVDDKNNPIDIQDMGVRIVPLAENEGDKFTKGQDITVNADRTRARGQRRNYDRFQLRRQALTEKLRSLNMLPDEHLIKLPIMELWQLRANAVTQKVSLNELGRILYHLNQKRGYKHSRTDAKDSKQRAYVKEINNRYGELIKSGMTIGQFFAKKLSETAVTVEGKTFYVYRIKDQIFPRKAYEEEYDSIMKCQQTFYQEILTNDVIDEIRNRIIYYQRDLRSCKHLVSVCEFEKRCFYDAEGNVKRNKKGEIIYDGPKVVPRTSPLFQIFKNWQSINNLRFHNRKNEYLYITKEQKQQIANIMDIHKVLKLEDVQNVLDITSESGWYCDKAIKAGIKGNTTKHAILSVLSSLPQSKITELTRFNLETEATNLVDEETGEVLVRIKSTYQEEPLYRLWHIIYSIKNEDERFNAISNLLKEFCIEDDSIASALKDLDFVTPGYANLSAKAISKILPYMMEGIDYSESCAYVGYNHSDSITKEENKRRELLDQIPALKKNELRQPTVEKILNQTINIFNQINTNLKKNGERIDEVRIELARELKQSKDERKETENGIRKQQKMNDEYANILKEEGIRPTRNRVLKYRLWRESNETCFYCERPINFNEFLKFSDIEREHIIPKKLIFDDSFANQVCSCRKCNKEKGGRTALDYMQTTPNLQMYLDKVDKMFQEHKISGKKHLHLLASYEDYLIRKKEGKETKDDIKIWETPIERQLRLSQYISRKAQELLRTACRDVIATSGSITDLIRHTWGYDTILHELNFDCYKKAGLTEFIKDEKTGKNREVIQDWTKRLDHRHHAIDALAVACTSRSIIQRINTLHASREDIRKEIKSTRKEWQENDLLQQWIKEKMPFDRKYVLHKVASILVSMKAGKKATVPGKRKIYK

SEQ ID NO: 1250 - protein, 1154 aa, Unknown
  Description of Unknown: uncultivated organism with predicted taxonomy: Bacteroidales
  MG16-169 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGSYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKLLDISKKDGWYGGKAIGKGLKGNTTLNQLRKAMNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNEHENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDIDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1251 - protein, 1217 aa, Unknown; identical to SEQ ID NO: 1219
  Description of Unknown: uncultivated organism
  MG16-170 effector

SEQ ID NO: 1252 - protein, 1153 aa, Unknown; identical to SEQ ID NO: 1242
  Description of Unknown: uncultivated organism with predicted taxonomy: Bacteroidales
  MG16-171 effector

SEQ ID NO: 1253 - protein, 815 aa, Unknown
  Description of Unknown: uncultivated organism with predicted taxonomy: Prevotella brevis
  MG16-172 effector
MKKHILGLDLGVGSIGWALIETEDDQPKQIIGMGSRIVPISKDDSDQFSKGQAISKNADRTARRTTRKGYDRYQLRRALLTQVLRQNGMLPERMDENVIDLWKLRSDAATEGHQLTLPQIGRVLYHMNQKRGYKHAKADDNGDSKQTKYVEAVNQRYTEIQEAKQTVGQHFYLELLRSKVESGNGPYYTFRIKDKVFPRAAYIAEFDQIMKVQKAYHPEVLTDEFIDTLRNRIIFYQRPLKSCKHLVSLCEFEMKPYKNKDGKIVYGGPKCAPRTSPLAQLCTMWETVNNITLTNRNNERYEFSLDERRQLVEHLCTHEVLKLTDLYKILGITKKDGWYGGKAIGKGIKGNATLNQLRKALNGKYSDWLEMPIERIDAVDNETAEVFWQVSPKVEETPLFKLWHAVYSIQDAEELAKTLRNKFGIDDQEVIDALCKIDFVKPGYANKSHKFIRRLLPYLMEGMMYSEACARIGINHSNSMTAAERDARPLAEHIELLQKNALRQPVIEKILNQMINLVNRLQQEYGPIDEARVELARELKQSREEREGAYRRNNQNERLNKEIAAKIEEMGIRPSRSRIQKYKMWEETNHRCMYCGKTVSLAEFLNGADVEIEHIIPRSILFDDSFSNKVCACRECNHEKGNMTALDYIETKPAAEVEAYKQRVDEAFKEGQISKTKRDHLLWHKSDIPTDFIDRQLRQSQYIAVKAVEILQQAIRQVWTSGGSVTDFLRHQWGYDEILHTLNLPRYRQVEDLTEIVHYEHAGQEHEEERIKNWSKRIDHRHHAIDALTVALTRQAYIQRLNSLNAEFTREEMLK

SEQ ID NO: 1254 - protein, 1266 aa, Unknown; identical to SEQ ID NO: 1226
  Description of Unknown: uncultivated organism with predicted taxonomy: Bacteroides
  MG16-173 effector

SEQ ID NO: 1255 - protein, 1149 aa, Unknown
  Description of Unknown: uncultivated organism with predicted taxonomy: Bacteroidetes
  MG16-174 effector
MKKKILGLDLGVGSIGWALIETEDNQPKQILGMGSRIVPISKDDNDQFSKGQAITKNADRTQRRTTRKGYNRYQMRRALLTQALRNNNMLPERMDENVIDLWKLRSDAATEGHQLTLSQIGRVLYHMNQKRGYKHSKADDNGDSKQTKYVEEVNQRYKEIQEAHQTIGQHFYLELLRSKIERANGPYYTYRIKDQVFPRAAYMAEFDQIMQTQRVFYPEVLTDEFIDTLRNRIIFYQRPLKSCKHLVSLCEFEARPYKTKEGKIVYGGPKCAPRTSPLAQLCAIWETTNNITLTNRNNEKYEFTLEHRRQIVDFLCHNKEMKVSHLQKILGIGRNDGWYGGKAIGKGIKGNATLNQLRDALQGKYDQWLEMPIKRVDVVDATTGEVFWAVSAEIEETPLFRLWHAVYSLQNAEELAKTLREKFLITDESVIEALCRIDFVKPGYANKSHKFIRRLLPYLMEGMMYSEGCERININHSNSMTREEREQRPLKEHIQLLQKNQLRQPVVEKVLNQMINIVNSLKDQYGEIDEARVELARELKQSRDERESAYKAMGKNERRNKEIAEKIAEFGIRPSRSRIQKYKMWEESMHQCFYCGKTIDLAEFLNGADVEIEHIIPRSILFDDSFSNKVCACRRCNQEKSNQTAMEYMETKPVGELEAYKRRVDEAFTAKRISKTKRDHLLWRKADIPTDFIERQLRQSQYIAVKAVEVLQDGIRQVWTSGGSVTDFLRHQWGYDEILHTLNLPRYRQVEGLTEFVDYEHAGQKHTEERIKNWTKRIDHRHHAIDALTVALTQQGYIQRLNTLEASHDFMEKQVKETGTHYNEKKSILEKWINEQPHFSVEDVTSAVDGILVSFRAGKRVTTPARRAIYKGGKRVIVQRGIEVPRGALTNEFVYTKKGNKYARKYPINAISNPDNIVDETIRQLVKSRLIACGGNTNEAFKTPLYSAEGMEIKTVRCFNNKLSDRGVVAIKYNENNEPIGYAETDNNHHMAIYRQKDGSLKEKIVSFWDAVERKRYGVPVVIANPHEVWDSLLNTEFPQEFLAKLPKDDWQYVLSMQENEMFVLGMEDDEFNDAIERQDYTALNKHLYRVQSISHDDYYFCHHTETKATEKSESLKLGKTLRIRGVNSLKNYFPHKVKVDILGHIHKV

SEQ ID NO: 1256 - protein, 1258 aa, Unknown
  Description of Unknown: uncultivated organism with predicted taxonomy: Prevotella
  MG16-175 effector
MKNILGLDLGTTSVGWALIKVDDKNNPIDIQDMGVRIVPLAENEGDKFTKGQDITVNADRTRARGQRRNYDRFQLRRQALTEKLRSLNMLPDEHLIKLPIMELWQLRANAVTQKVSLNELGRILYHLNQKRGYKHSRTDAKDSKQRAYVKEINNRYGELIKSGMTIGQFFAKKLSETAVTVEGKTFYVYRIKDQIFPRKAYEEEYDSIMKCQQTFYQEILTNDVIDEIRNRIIYYQRDLRSCKHLVSVCEFEKRCFYDAEGNVKRNKKGEIIYDGPKVVPRTSPLFQIFKNWQSINNLRFHNRKNEYLYITKEQKQQIANIMDIHKVLKLEDVQNVLDITSESGWYCDKAIKAGIKGNTTKHAILSVLSSLPQSKITELTRFNLETEATNLVDEETGEVLVRIKSTYQEEPLYRLWHIIYSIKNEDERFNAISNLLKEFCIEDDSIASALKDLDFVTPGYANLSAKAISKILPYMMEGIDYSESCAYVGYNHSDSITKEENKRRELLDQIPALKKNELRQPTVEKILNQTINIFNQINTNLKKNGERIDEVRIELARELKQSKDERKETENGIRKQQKMNDEYANILKEEGIRPTRNRVLKYRLWRESNETCFYCERPINFNEFLKFSDIEREHIIPKKLIFDDSFANQVCSCRKCNKEKGGRTALDYMQTTPNLQMYLDKVDKMFQEHKISGKKHLHLLASYEDYLIRKKEGKETKDDIKIWETPIERQLRLSQYISRKAQELLRTACRDVIATSGSITDLIRHTWGYDTILHELNFDCYKKAGLTEFIKDEKTGKIREVIQDWTKRLDHRHHAIDALAVACTSRSIIQRINTLHASREDIRKEIKSTRKEWQENDLLQQWIKEKMPFDRKYVLHKVASILVSMKAGKKATVPGKRKIYKNGKPTIIQSGMRIPRGQLHEQTVYGAITQFSKNNKGKVFQTKEIVTRYKMGVGSMGYVFSGKETCDVINDKKNKSLVIIDGIEKAINYIVDRHIRDVVRNRLNEAFPENETYRSEAEKALAEGKKYDGKERCQKALDQLRKLSEKPLYADKNKNIIIKSARCYTGLSAVQPLRYNNNHEPISYVLTKNNHHVALYKDENGKFQECIYTFWQVVERSKFKLPLIITDTKALWNEIQQRENKGDTFPDSLIQSLPLPNWTFIESLQLNDMFVMDINDDDFEHYIATNNYEELGKKLYRIQNISSFDYSFRLHTDTTSKTTSDAALSKRYIRIKSIKAYIEHNPHKVKISLLGKIIRNTE

SEQ ID NO: 1257 - protein, 1154 aa, Unknown
  Description of Unknown: uncultivated organism with predicted taxonomy: Bacteroidales
  MG16-176 effector
MKKKILGLDLGVGSIGWALIETEDNQPQKILGMGSRIVPISKDDNDQFSKGQAITKNADRTARRTTRKGYNRYQMRRALLTQALRNNNMLPERMDENVIDLWKLRSDAATEGHQLTLPQIGRVLYHINQKRGYKHSKADKNGDSKQTKYVEAVNQRFKDIQEIHQTIGQHFYLELLRTRVHRENGDYYTYRIKDQVFPRAAYIAEFDQIMNVQRAYYPEVLTDEFIDTLRNCIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKRIDVVDATTSEVFWAVSPEIEETPLFKLWHAVYSLQNADELAKTLREKFQITDEAVIEALCKIDFVKPGYANKSHKFIRRLLPYLMEGMMYSEACKRININHSNSMTREEREQRPLSARIQLLQKNQLRQPVVEKVLNQMINIVNSLKDQYGEIDEARVELARELKQSRDERESAYKAMGQNERRNKEIAAKIAEFGIRPSRSRIQKYKMWEESLHQCFYCGKTIDLSEFLNGADVEIEHIIPRSILFDDSFSNKVCACRRCNQEKGNQTAMEYMETKSAAEQETYKQRVDEAFTAKRISKTKRDHLLWRKADIPADFIERQLRQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEEVTNAVDGILVSFRAGKRVTTPARRAIYKGGKRVIAQRGIEVPRGALTEETIYGKLGDKFTVKYPLDHPSMKPENIVDPTIRALVQKRVAERGKDAFKDPLYSAEGMKIKSVRCFANVTDNSVVPIKYNGEGQPIGYAKKGNNHHVAIYTDKSGKPQESVVSFWDAVERKRYGVPVVITNPHEVWDNLLNTDFPQEFLAKLPEDDWQYLFSMQENEMFVLGMEDDEFYDAIERQDYASLNKHLYRVQKIRSGEYTFRYHTETKVDDKYEGVANGTNTSFQLGALVSIRGFSSLFAKHPHKVKVDILGHIHKA

SEQ ID NO: 1258 - protein, 1154 aa, Unknown; identical to SEQ ID NO: 1234
  Description of Unknown: uncultivated organism with predicted taxonomy: Bacteroidia
  MG16-177 effector

SEQ ID NO: 1259 - protein, 1104 aa, Unknown
  Description of Unknown: uncultivated organism with predicted taxonomy: Porphyromonas sp. oral taxon 278
  MG16-178 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGPYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKALNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNERENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDIDLPQEFLLKLPQDDWQYVLSMQENEMFVLGMEEDEFHDALERHDYCSLNKHLYRVQKISHGEYVLRYHTET

SEQ ID NO: 1260 - protein, 1217 aa, Unknown; identical to SEQ ID NO: 1219
  Description of Unknown: uncultivated organism
  MG16-179 effector

SEQ ID NO: 1261 - protein, 1130 aa, Unknown
  Description of Unknown: uncultivated organism with predicted taxonomy: Bacteroidales
  MG16-180 effector
MKKKILGLDLGVGSIGWALIETENDQPKQIVGMGSRIVPISKDDNDQFSKGQAISKNADRTARRTTRKGYDRYQLRRALLTQVLRQNGMLPERMDENVIDLWKLRSDAATEGLQLTLPQIGRVLYHINQKRGYKHAKADDNGDSKQTKYVEAVNQRYADLQGEKQTIGQHFYLELLRSKVEGASGPYYTFRIKDKVFPRAAYIAEFDQIMRVQRAYYPEILTEELIDTLRNRIIFYQRPLKSCKHLVSLCEFEMRPYKTKDGKIVYSGPKCAPRTSPLAQLCAMWETANNITLTNRNNERYEFSLEERQQIVEHLCTHDALKLTDLYKILGISKKDGWYGGKAIGKGIKGNVTLNQLRKALNGKYGQWLEMPIEHVDVVDNTTAEVFWAVSPKVEETPLFKLWHAVYSLQDAEELAKTLRNKFGITDQEVIDALCKIDFVKPGYANKSHKFIRRLLPYLMEGMQYSEACTRIGINHSNYMTAAERDARPLAERIELLQKNALRQPVIEKILNQMINLVNRLQQEYGPIDEARVELARELKQSREERENAFKRNNQNERLNKEIADKIEEMGIRPSRSRIQKYKMWEESNHRCMYCGKTVSLAEFLNGADVEIEHIIPRSILFDDSFSNKVCACRECNHEKDNMTALDYLETKPAVEVDAYKQRVDEAFKEGRISKTKRDHLLWHKSDIPQDFIDRQLRQSQYIAVKAVEILQQGIRQVWTSGGSVTDCLRHQWGYDEILHTLNLPRYRQVEDLTEIVHYEHAGQEHDEERIKNWSKRIDHRHHAIDALTVALTRQAYITRLNSLNAEFTREEMLKEVEEANTVYNEKKSLLEKWVNEQPHFSVEDVTQSVDGILVSFRAGKRVTTPARRAIYNGGKRTIVQRGLQVPRGALTNEFVYTKNGNKYARKYPINAISNPENIVDPTIRQLIKARLAAFNGNAKEAFKEPLYSAEGMEIRTVRCYNNKLSDRGVVAMKYNERREPIGYAETDNNHHLAIYRDSKGELQESIVSFYEAVKRKIAGLPIMDEHPEPDWNLVQTMQENEMFVLGMNDEDFEKSIANDDYQLLNKHLYRVQSISHDDYYFCLHTESKATDKNECMKLGSILRIRGVNSLQKYNPHKVKIDIMGRITKA

SEQ ID NO: 1262 - protein, 1154 aa, Unknown; identical to SEQ ID NO: 1237
  Description of Unknown: uncultivated organism with predicted taxonomy: Bacteroidales
  MG16-181 effector

SEQ ID NO: 1263 - protein, 1219 aa, Unknown
  Description of Unknown: uncultivated organism with predicted taxonomy: Prevotella
  MG16-182 effector
MKKVLGLDLGVGSIGWCLIEKDDDNTPKRIIRMGSRIVPISSDEESGYTRGNAISKNADRTAKRTSRKCYDRYQLRRQALLNLLKRLGMEPSKKLIFEQNPLELWQKRADAASKEITIEELGRVLLHINQKRGYKHSRLSNSDSKETAYVQEVNSRYDDLKAEGLTIGQHFAAKLKENEQTSADGKKYYTYRIKEQVYPRHAYEEETEKILEVQSRYHADILTPDVCKEIKDIIFYQRDLKSCKNLVSLCEFESYTITKDGKEMTIGPKVAPRTSPLAQLSSILETANNITIRNRRNDELYISPEQRKAIADFLDNHEVMKLTDLYKILNIGRKDGWWAGKAIGKGLKGNTTKCQIREALSNLSKEQIESLTAFKLEYDEYVDAETGEVRKRINNTLAEKQPLYRLWHLLYSIKDVDELSGALRRLGIENEESIQNLCNLDFRTAGYANKSAKAIGRILPYLMDGMMYSDACELAGFDHSRRINPDRVLLTSLPQIQKNELRQPVVEKILNQLVNVVNALLEKEGPIDESRVELARELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMSRKAQGKETEEDKELWENFIDRQLRQSQYIARKSVEMLQQICKNVYFTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTRITVPGKRYITKNGKRALVQTGIIVPRGALHAEFVYGRIMKQEADGVTLTPQYVRKYKLGIGAQGFLFNGKEFYKEELKRDSKTGLSSIVVTDKIKDVLEKVVDGGIRHRILERLNRGFEEGADYRANVAQALSNLKNLDEDPIFSDDAKTRPIRTVRKYVSSSTMVAVRKDGNGKPMSFVEPDGNHHVAFYKNEDGTITESIVTKWQAVQRKLNRIPIIIDNPSQTWSEIMGRNDVPEELLQTLPKDKTTFLLSLQIGEAFIMGMDEADFQKAFEEKDMQTLAEHLYFVQSISSSDYRFRRHIEAQYDTNDINKEDKRFLRIRKIQALFEYNPHKAKITVLGD

SEQ ID NO: 1264 - protein, 756 aa, Unknown
  Description of Unknown: uncultivated organism with predicted taxonomy: Prevotella
  MG16-183 effector
MKKVLGLDLGVGSIGWCLIEKDDDNTPKRIIRMGSRIVPISSDEESGYTRGNAISKNADRTAKRTSRKCYDRYQLRRQALLNLLKRLGMEPSKKLIFEQNPLELWQKRADAASKEITIEELGRVLLHINQKRGYKHSRLSNSDSKETAYVQEVNSRYDDLKAEGLTIGQHFAAKLKENEQTSADGKKYYTYRIKEQVYPRHAYEEETEQILEVQSRYHADILTPDVCKEIKDIIFYQRDLKSCKNLVSLCEFESYTITKDGKEMTIGPKVAPRTSPLAQLSSILETANNITIRNRRNDELYISPEQRKAIADFLDNHEVMKLTDLYKILNIGRKDGWWAGKAIGKGLKGNTTKCQIREALSNLSKEQIESLTAFKLEYDEYVDAETGEVRKRINNTLAEKQPLYRLWHLLYSIKDVDELSGALRRLGIENEESIQNLCNLDFRTAGYANKSAKAIGRILPYLMDGMMYSDACELAGFDHSRRINPDRVLLTSLPQIQKNELRQPVVEKILNQLVNVVNALLEKEGPIDESRVELARELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMNRKAQGKETEEDKELWENFIDRHLRLSPYIARKSVEMLQQICKNVYSTSGSVTDFVRHQWGYDEILH

SEQ ID NO: 1265 - protein, 1154 aa, Unknown
  Description of Unknown: uncultivated organism with predicted taxonomy: Bacteroidales
  MG16-184 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQAKYVEAVNQRYKEIQESKQTIGQHFYLELLRSKVDGVRGPYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKAMNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNERENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKETGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDKDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1266 - protein, 930 aa, Unknown
  Description of Unknown: uncultivated organism with predicted taxonomy: Fibrobacter
  MG16-185 effector
MKKILGLDLGVSSIGWSVISVDKNGDPSEILGMGSRIVPLSTDDANEFSTGNAISKNQKRTQKRTARKGYDRYQLRRENLTAELRKHQMLPDERLIKLPVLDLWTLRANAATEGCKLSLPEIGRVLYHINQKRGYKHAKADEAGDKKQTEYIENVNKRFAMIKELGLTIGQFFANKLKESEVVSEKGTFYTYRTKEQVFPRGAYIAEFDQIIEVQRKFYPQVFTDEFINRLRNEIIFYQRNLKSCKHLVSLCEFEKREYKNKDGKIVFDGPKVAPRTSPLFQICRIWEFVNNIRLDGYKETKALSQDERLKVVDFLDNHEKMTAKDFIKLLGLDKNDEWDLKRYFGKNGVQGNSTKTQLAAALANIPNTSELLRFNLALENSNYVNKSTGEVLKVISSDFQNEPLYMLWHTVYSISDKEELKNALNKKYGITDESVINSLFKIDFVKPGFGNKSAKAIRRILPFLQEGLVYSDACAEAGYNHSDSLTKSENEARTLLARLPQIKKNELRQPVIEKILNQMVNVVNAIYDEYGQIDEIRVELARELKQSKDERNTTASNIAKRERENEKIEAKIQEFGIRSSRNRIQKYRLWEESEQKCFYCGDTVNVKEFLSGLDVEVEHVIPKSLLFDDSFANKVCACRKCNAAKGNKTAYDFMEGQKKEVFDAYVKRVNDFYKDGKISKTKKERLLTTQSKIPSDFIERQLRQTQYIAKKALEMLKNVCYNVYATSGSITDFIRHIWGYDEILHQLNFERYKKGGLTEFREYDHKGETHTEERIQNWSKRLDHRHHAIDALVIAMTRQSIIQRLNHLNTERDAMFQEVEKQSKEWKNDYSMLQEWLRERKHFSTEDVAKKVSNILVSFKAGKRVATIGKRVKYEHEKKFILQTGIVIPRGPLSEESVYGKIKVLDRNKPLKYLFENPQSIVNTDIKSA

SEQ ID NO: 1267 - protein, 1222 aa, Unknown
  Description of Unknown: uncultivated organism with predicted taxonomy: Prevotella
  MG16-186 effector
MKKVLGLDLGVGSIGWCLVEKDDKNIPLRIIRMGSRIVPITKEEENGYTRGNAISKNADRTVKRTARKCYDRYQLRRKALVNLLKRCGMMPDKGLILEQSPLDLWQKRADAASKEISLEEVGRVLLHINQKRGYKHSRLSNSDKKETAYVQEVNSRYDKLKAEGLTVGQHFAAKLKENEQISADGKKYYNYRIKEQVYPRHAYEEEAKRILEVQSQFHTDVLTTNVCKEIFDTIFYQRDLKSCKNLVSFCEFESYTIKRNGKDITIGPKVAPRTSPLAQLSSILETANNITIRNRRNDELYISPEQRQAIANFLDNNEVMKLTDLYKILNIGRKDGWWAGKAIGKGLKGNTTKCQIRKALSKLSQEQIDKLTSFNLIFDEYVDEETGELRKRINNSHAEHQPLYRLWHLIYSIKDNDELSIALRSLGIEDEVCIHNLCNLDFRTAGYANKSAKAIGRILPYLMEGMMYSEACNRAGFDHSRRVNPERELLTSLPQIQKNELRQPIVEKILNQLVNVVNALLEKEGTIDEIRVELARELKQSKDERNETYRRNNQNEKKNKEYAERIKKYELTPTRNRIMKMKMLEESEYKCMYCGQPVKEKEFLQGADVEREHIIPRALLFDNSFTNQVCSCRSCNSQKGMRTAYDFIADDKGQEGLEAYIERINDLFNKKKISRSKLNRLLVSYKAYVSRKAQGKETEEDVQLWENFIDRQLRQSQYIAKKSVEILQQVCKNVYTTSGSVTDFVRHQWGYDEILHDLNFERFKKANLTTMVKQLHSGKEVEVERIKDWTKRLDNRHHAVDALAIACTTQGMIQRLNTLNASRDAMLDELNNKEQRMIDSERSMLEKWIISQPHVSCVEAKKEIDKILISLRPNTRITVPGKRYITKNGKRTLVQTGIIVPRGALHAEFVYGRIMKQEADGVTLTPQYVRKYKLGIGTQGYIFNGNETYKEELKKDKKTGLSQIVVTDKIKDVLDKIVDGGIRKRILERLNRGFEDGTDYRTNTAKALENLKNLDEDPIYSDDAKTRPIRTVRKYVNSSTMVAVRKDDNGKPVSFVVPDDNHHVAFYKDKDGVITESIVTKWQAVQRKLNHIPIIVDNPTQTWNDLVGRNDVPEELLQSLPKDNSEFLLSLQIGEAFIMGMEDADFHRAIEEKDIHNLAEHLYFVQNISSNNYRMRRHVEASFDTSDMNKEDQRFLNVSSIGAFFNYNPHKVKVTILGDIIK

SEQ ID NO: 1268 - protein, 1155 aa, Unknown
  Description of Unknown: uncultivated organism with predicted taxonomy: Bacteroidales
  MG16-187 effector
MKKKILGLDLGVGSIGWALIETEDNQPQKILGMGSRIVPISKDDNDQFSKGQAITKNADRTARRTTRKGYNRYQMRRALLTQVLRNNNMLPERMDENVIDLWKLRSDAATEGHQLTLPQIGRVLYHINQKRGYKHSKADENGDSKQTKYVEAVNQRFKDIQEAHQTIGQHFYLELLRTRVHRENGDYYTYRIKDQVFPRAAYIAEFDQIMSVQRAYYPEVLTDEFIDTLRNRIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKRIDVVDATTSEVFWAVNPDVEETPLFKLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYRAMGQNERRNKEIAAKIAEFGIRPSRSRIQKYKMWEKSLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPSDFIERQLRQSQYIAVKAVEVLQDGIRQVWTSGGSVTDFLRHQWGYDEILHTLNLPRYHQVEGLTEFVDFEHAGQKHTEERIKNWSKRIDNRHHAIDALTVALTQQGYIQRLNTLEASHDFMEKQVKEAGTKYNEKKSILEKWINEQPHFSVEDVTNAVDGILVSFRAGKRVTTPARRAIYKGGKRVIVQRGIEVPRGALTEETIYGKLGDKFTVKYPLDHPSMKPENIVDPTIRALVQKRVAERGKDAFKEPLYSAEGMKIKSVRCYTSLSENGVVPVKYDEAGKPIGYAKKGNNHHIAIYQDKDGQYQEMVVSFWDAVERKRYGVPVVITNPHEVWDSLLNKDLPQEFLAKLPNDNWQFVLSMQENEMFVLGLEDDEFNDAIERQDYAALNKHLYRVQKISHREYTFRYHTETKVDDKYEGMENGRTTSISLGASIPFKSISALLAKFPHKVKVDLLGHIHSKK

SEQ ID NO: 1269 - protein, 1222 aa, Unknown
  Description of Unknown: uncultivated organism
  MG16-188 effector
MKKVLGLDLGVGSIGWCLIEKDDNNTPKRILRMGSRIVPISSDEETGYTKGNAISKNADRTAKRTARKCYDRYQLRRQALVNLLKRLGMEPNKNLMLEQTPMELWQKRADAASKEISLEELGRVLLHINQKRGYKHSRLSNSDSKETAYVQEVNSRYDDLKAEELTVGQHFAAKLKENEQISADGKKYYNYRIKEQVYPRHAYEEETKKILEVQSRYHSDVLTPDVCKEMMDIIFYQRDLKSCKNLVSLCEFESYTITKDGKEITIGPKVAPRTSPLAQLSSILETANNITIRNKRNDELYISPEQRKAIADFLDNHEVMKLTDLYKILNIGRKDGWWAGKAIGKGLKGNTTKCQIREALSAHPKEQVDSLIAFQLEFDEYVDEETGEVSKRINNTLAEQQPLYKLWHMLYSIKDNRELSGALQHLGIEDNESIEKLCNLDFRTAGYANKSAKAIGRILPYLMEGVMYSEACERAGLDHSRRIDPNRPLLKHLPQIQKNELRQPVVEKILNQLVNIVNALLEKEGAIDEIRVELARELKQSKDERNETFKRNNQNERQNKEYAERIKKYGLTPTRNRIMKLKMWEESEHACMYCEQPVDPIEFLKGSDVEREHIIPRGLLFDNSFTNQVCSCRRCNSKKGMRTAYDFIADDKGQEGLNAYIEHINDLFDKKKISRSKLNRLLVSHKAYISRKAQGKETEEDKDLWENFIDRQLRQSQYIAKKSVEMLQLVCKNVYVTSGSVTDFVRHQWGYDELLHDLNFERFKKAGLTTMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYITKNGKRTLVQTGIIVPRGALHAEFVYGRIMKQKTDGVTMTPQYVRKYKLGIGAQGFLFNGKEFYKEELKKDSKTGLSKIVVTDKIKDVLEKIVDGGIRQRILERLNRGFEEGTDYRANVAQALANLKNLDEDPIYSDDAKTRPIRTVRKYVSSSTMVAVRKDDNGKPVAFVEPDGNHHVAFYKDENGVITETIVTKWQAVQRKLYHIPIIIDNPSQTWNEVLERKDIPEELLQSLPKDSFTFLLSLQIGEAFIMGMEEADYQRALEEKDMQTLAKHLYFVQSISSCDYRFRRHVEAQYDTNDINKEDLRFLRIRNLQALFEYNPQKVKVTVLGDLIH

SEQ ID NO: 1270 - protein, 1222 aa, Unknown
  Description of Unknown: uncultivated organism
  MG16-189 effector
MKKVLGLDLGVGSIGWCLIEKDDNNTPKRILRMGSRIVPISSDEETGYTKGNAISKNADRTAKRTARKCYDRYQLRRQALVNLLKRLGMEPNKNLMLEQTPMELWQKRADAASKEISLEELGRGLLHINQKRGYKHSRLSNSDSKETAYVQEVNSRYDDLKAEELTVGQHFAAKLKENEQISADGKKYYNYRIKEQVYPRHAYEEETKKILEVQSRYHSDVLTPDVCKEMMDIIFYQRDLKSCKNLVSLCEFESYTITKDGKEITIGPKVAPRTSPLAQLSSILETANNITIRNKRNDELYISPEQRKAIADFLDNHEVMKLTDLYKILNIGRKDGWWAGKAIGKGLKGNTTKCQIREALSAHPKEQVDSLIAFQLEFDEYVDEETGEVSKRINNTLAEQQPLYKLWHMLYSIKDNRELSGALQHLGIEDNESIEKLCNLDFRTAGYANKSAKAIGRILPYLMEGVMYREACERAGLDHSRRIDPNRPLLKHLPQIQKNELRQPVVEKILNQLVNIVNALLEKEGAIDEIRVELARELKQSKDERNETFKRNNQNERQNKEYAERIKKYGLTPTRNRIMKLKMWEESEHACMYCEQPVDPIEFLKGSDVEREHIIPRGLLFDNSFTNQVCSCRRCNSKKGMRTAYDFIADDKGQEGLNAYIEHINDLFDKKKISRSKLNRLLVSHKAYISRKAQGKETEEDKDLWENFIDRQLRQSQYIAKKSVEMLQLVCKNVYVTSGSVTDFVRHQWGYDELLHDLNFERFKKAGLTTMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYITKNGKRTLVQTGIIVPRGALHAEFVYGRIMKQKTDGVTMTPQYVRKYKLGIGAQGFLFNGKEFYKEELKKDSKTGLSKIVVTDKIKDVLEKIVDGGIRQRILERLNRGFEEGTDYRANVAQALANLKNLDEDPIYSDDAKTRPIRTVRKYVSSSTMVAVRKDDNGKPVAFVEPDGNHHVAFYKDENGVITETIVTKWQAVQRKLYHIPIIIDNPSQTWNEVLERKDIPEELLQSLPKDSFTFLLSLQIGEAFIMGMEEADYQRALEEKDMQTLAKHLYFVQSISSCDYRFRRHVEAQYDTNDINKEDLRFLRIRNLQALFEYNPQKVKVTVLGDLIH

SEQ ID NO: 1271 - protein, 1224 aa, Unknown
  Description of Unknown: uncultivated organism with predicted taxonomy: Prevotella ruminicola
  MG16-190 effector
MKKVLGLDLGVGSIGWCLIEKDDNNTPRRILRMGSRIVPISSDEESGYTRGNAISKNADRTAKRTARKCYDRYQLRRQALVNLLKILGMEPNKNLMFEQTPLELWQKRADAASKEITLEELGRVLLHINQKRGYKHSRLSNSDSKETAYVQEVNSRYVVLRAEGLTVGQHFAAKLKENEQESTDGKKYYNYRIKEQVYPRHAYEEEVKKILEVQSQYHSDVLTSDVCKEIGDIIFYQRDLKSCKNLVSFCEFESYTIKKDGKKITIGPKVAPRTSPLAQLSSILETANNITIRNRRNDELYISPEQRKAIAEFLDNHEVMKLTDLYKILNIGKKDGWWAGKAIGKGLKGNTTKCQIREALSGLPKEQVDSLTAFKLEIDEYVDEETGEVRKRIDNTKAEKQPLYRLWHLLYSIKDNDELTGALRHLGIENKEIIEKLCKIDSRTAGYANKSAKAIGRILPYLMDGVMYSEACGRAGYDHSRRVNPDRVLLTHLPQIQKNELRQPVVEKILNQLVNIVNALLEKEGAIDEIRVELARELKQSKDERNEVFKRNSQNERKNKEYAERIKEYGLTPTRNRIMKMRMWEESEYTCMYCGQPVNVSEFLKGADVEREHIIPRGLLFDNSFTNQVCSCRRCNSKKGMRTAYDFIADEKGQEGLDIYIDRINDLFNRKKISRSKFNRLMASHKAYMSRKAQGKETDEDKELWENFIDRQLRQSQYIAKKSVEMLQQVCKNVYTTSGSVTDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTRITVPGKRYVIKSGKRTLAQTGIIVPRGALHAEFVYGRIQKQEADGDTKTYQYVRKYKLGIGAQGFLFNGKEFYKEELKKDSKTGLSSIVVTDKIKDVLDKIVDGGIRQRILERLNRGFEEGADYRANVARALENLKNLDEDPIYSDDAKTRPIRTVRKYVSSSTMVAVRKDSNGKAISFVEPDGNHHVAFYKDENDVITENIVTKWLAVQRKLNHMPIIIDNPSQTWSEILKRNDVPEELLQSLPKDSSTFLLSLQIGEAFIMGMEDGDYQKALEEKDMQTLADHLYFVQNISSNNYRLRRHVESSFDTTDMNKEDQRFLNIKSVNSFFNSNPHKVKITILGDIITDV

SEQ ID NO: 1272 - protein, 1155 aa, Unknown
  Description of Unknown: uncultivated organism with predicted taxonomy: Labilibaculum filiforme
  MG16-191 effector
MKKKILGLDLGVGSIGWALIETEDNQPQKILGMGSRIVPISKDDNDQFSKGQAITKNADRTARRTTRKGYNRYQMRRALLTQVLRNNNMLPERMDENVIDLWKLRSDAATEGHQLTLPQIGRVLYHINQKRGYKHSKADENGDSKQTKYVEAVNQRFKDIQEAHQTIGQHFYLELLRTRVHRENGDYYTYRIKDQVFPRAAYIAEFDQIMSVQRAYYPEVLTDEFIDTLRNRIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKRIDVVDATTSEVFWAVNPDVEETPLFKLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAAKIAEFGIRPSRSRIQKYKMWEKSLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPSDFIERQLRQSQYIAVKAVEVLQDGIRQVWTSGGSVTDFLRHQWGYDEILHTLNLPRYHQVEGLTEFVDFEHAGQKHTEERIKNWSKRIDNRHHAIDALTVALTQQGYIQRLNTLEASHDFMEKQVKEAGTKYNEKKSILEKWINEQPHFSVEDVTNAVDGILVSFRAGKRVTTPARRAIYKGGKRVIVQRGIEVPRGALTEETIYGKLGDKFTVKYPLDHPSMKPENIVDPTIRALVQKRVAERGKDAFKEPLYSAEGMKIKSVRCYTSLSENGVVPVKYDEAGKPIGYAKKGNNHHIAIYQDKDGQYQEMVVSFWDAVERKRYGVPVVITNPHEVWDSLLNKDLPQEFLAKLPNDNWQFVLSMQENEMFVLGLEDDEFNDAIERQDYAALNKHLYRVQKISHREYTFRYHTETKVDDKYEGMENGRTTSISLGASIPFKSISALLAKFPHKVKVDLLGHIHSKK

SEQ ID NO: 1273 - protein, 1222 aa, Unknown
  Description of Unknown: uncultivated organism with predicted taxonomy: Bacteroidales
  MG16-192 effector
MKKVLGLDLGVGSIGWCLIEKDDNNTPKRILRMGSRIVPISSDEETGYTKGNAISKNADRTVKRTARKCYDRYQLRRKALVNLLKRLGMEPNENLMFEQTPIELWQKRADAASKEVSLEELGRVLLHINQKRGYKHSRISNSDIKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFNLEIDENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVEILLQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKRTLAQTGIIVPRGALHAEFVYGRIMRQEADGVTMTPQYVRKYKLGIGAQGFLFKGDEVYKEEVKKNSKTGLSKIVVTDKIKDVLDKIVDGDIRQRILERLNRGFEEGVDYRVNVAKALANFKNLDDDPVYSDDAMTRPIRTVRKYVSSSTMVAIRMDSNGRPIAFVEPDDNHHVAFYKDEDDEKKEIVVTKLLAVQRKLNHIPIIIDNPSQTWSEVLGRNDVPEELLQSLPKDKSIFLLSLQKGEAIIMGLEEMDYQRAILAKDMRTLCNHLFYVQSASSRDYRFRRHVEVKYDTKDINKDDMRFLRIRTINELFKINPHKVKVTVLGDIIE

SEQ ID NO: 1274 - protein, 1226 aa, Unknown
  Description of Unknown: uncultivated organism
  MG16-193 effector
MKKILGLDLGVGSIGWSVISVDENGDPSEILGMGSRIVPLSTDDANEFSTGNAISKNQKRTQKRTARKGYDRYQLRRENLTAELRKHQMLPDEHLIKLPVLDLWTLRANAATEGFKLSLPEIGRVLYHINQKRGYKHAKADEAGDKKQTEYVENVNKRFAMIKDLGLTIGQFFASKLKESEVVSEKGKFYTYRTKEQVFPRGAYIAEFDQIIEVQRKFYPQVFTDEFINRLRNEIIFYQRNLKSCKHLVSLCEFEKHEYKNKDGKIVFDGPKVAPRTSPLFQICRIWEFVNNIRLENGYKEARTLSQDERLKVVDFLDNHEKMTAKDFTKLLELNKNDEWDLKRYFGKNGTQGNTTKTQLATALANIPNASELLQFNLTLENSNYVNEKTGEVLKVVSSDFQNEPLYMLWHTVYSLSDKEGLKNTLNKKYGITEESVINNLFKIDFVKPGFGNKSAKAIRRILPFLREGLVYSDACVEAGYNHSDSLTKSENEARTLLSRLPQIKKNELRQPVIEKILNQMVNIVNAIYDEYGQIDEIRVELARELKQTKDERNTTASNIAKRERENKNIEAKIQEFGIRSSRNRIQKYRLWEESDQKCFYCGQPVQAKEFLSGLDVEVEHIIPKSLLFDDSFANKVCACRKCNAAKGNKTAYDFMKGQKEEVFDAYVKRVNDFYKDGKISKTKKERLLTTQSDIPSDFIERQLRQTQYIAKKAIEMLKDICYNVYATSGSVTDFIRHTWGYDEILHQLNFDRYKKGGLTELREYDHKGETHTEERIQNWSKRLDHRHHAIDALVIAMTRQSIIQRLNHLNTERDAMFQEVEKQSKEWKNDYSMLQEWLRERKHFPTEDVAKKVSDILVSFKAGKRVATIGKRVKYEHGKKIVLQTGITIPRGPLCEESVYGKIKVLDRNKPLKYLLENPQYIVNADIKFAITNRLAQYENDVKKAVQSLKKSPVVLANGKKLENADCYKEEFVIKYSLNGFKAKDIDSVVDNRIRNVLYKRLEEYNGNEKEAFKDIENNPIYADATHKIKIRNVRCFTGLSAVVPVKKDENGNAIGFVKPGNNHHVAIYKDENGNLQESVVTFWHAVERKKYGLPIVITNPIDAWKLAREQNCPKEFLDSLPNENWIYEQSLQENEMFVMGLDDNMYDKAVAEKNYALLNQHLYRVQKISSSDYYFRYHLETKLDDSASAIEIGKYKRIRSFKAFALAKPHKVKISLLGKLITRV

SEQ ID NO: 1275 - protein, 760 aa, Unknown
  Description of Unknown: uncultivated organism with predicted taxonomy: Sediminibacterium sp. C3
  MG16-194 effector
MKKVLGLDLGVGSIGWCLVEKDDNNTPTRILRMGSRIVPISSDEETGYTKGNAISKNADRTAKRTARKCYDRYQLRRKALQEMLKRLGIEPNKKLMLEQAPLELWQKRADAVSTKIALEDLGRVLLHINQKRGYKHSRLNNSDSKETAYVQEVNNRYDELKAEGLTVGQHFAAKLKDNEQTSADGKKYYNYRIKEQVFPRHAYEEEAKKILETQSRYYPDLLTPDVCKEIMNIIFYQRDLKSCKNLISYCEFESYTITKDGKEITIGPKVAPRTSPLAQLSSILESANNITIRNRKNDELYISPEQRKALADFLDNHEVMKVSDLYGILNIGRKDGWWAGKAIGKGLKGNTTKCQLREALKNLPQEKINALTSFNLEYDEYVDEETGEVRKRVNNHLAERQPLYRLWHLIYSIKDSDELAAALRRFGIDDEESILNLCNLDFRTPGYANKSAKAIGRILPYLAEGVMYSDACNMAGFDHTRRLNPNRPLLTSLPQIQKNELRQPVVEKILQQVVNIVNTLIEKEQSIDEIRVELARELKQSKDERNETFRRNSQNEKKNKEFAEHIKEYNLTPTRNRILKWKLYEESDHSCMYCGQSINIRDFLQGADAEREHIVPRGLLFDNSFTNQVCACRSCNSKKGMRTAYDFIEDEKGEEGLHSYIEHINYLFNKKNISRSKFNRLLVSHKAYLKRKALGKETEEDKELWDNFIDRQLRLSQYIAKKSVEMLQQVCRNVYSTSGSVTDFVRHQWGYDELLHDLNF

SEQ ID NO: 1276 - protein, 1248 aa, Unknown
  Description of Unknown: uncultivated organism with predicted taxonomy: Bacteroides
  MG16-195 effector
KMKNILGLDLGTTSIGWALIKTDNNNIPCEIRGMGVRRVPLAENEGDKFAQGQSVTINADRTKARGIRRNNDRYKLRRQALSEKLSSLGIEPNDSLMKLHMMDLWQLRANAATDRVSLPELGRILHHLNKKRGYKHSSKDEDKSMRDFLKNVRERYSELHCLNMTLGQFFAKKLLETAVTKGDKTYYVFRIKDLVFPRKAYEEEYDTIMQCQKKFYPNVLTDEVIDYIRNHIIYYQREPRSCKHLVSVCEFEKRHFYDKEGQLKRNNRNEIIYDGPKVAPRTSPIFQLYITCQSANNIRFHNKKKDYLYITREQRQRIVHFMDTNEKLKLADVKRILEINDKSEWYCDNAIKNGIKGNTTKCAIVNALSSLPQEKIAEITRFHLETEPTKDVDTETGEVLVKIKNNYQHEPLYRLWHIIYSIKKEEERTHAVTKFLQSFGVDNDDIVQKLSNIDFTTPGYGNISAKAICRILPYMMEGIEYSEACEYVGINHSNSLSKEENERRELMCQLPAIKKNSLRQPTVEKILNQTINVFNRINAELSQTGECINEVRVELARELKQSKDERHDTSEVIKALENKNKEYKTFIEKEYKLKATRKNLLRYRLWIESNQSCFYCLKPIKFTPFANESEEEREHILPKALHYDDSFANQVCSCKDCNSTKGGRTAMDYMRTTPYLQHYIDRVNKLYQANKISGKKYSHLLASYDDYQLRKKEGKETKEDILIWEKPIDRQLRLSQYISKKAMEILSFGCRDVVATSGSITAIIRHAWGWDTILEELNIQTYRNANLTEVIEVKSKGQNKKMETIKNWTKRLDNRHHAIDALVVACTSSSIIQRINTLNASKQKMRDEITSARKKWDENNILTQWIREKNPLNRKEVLEHVSSIFISMKAGKKVTVPGKRKEFKHGKAMIKQEGLRIPRGPLHEEGLYGSILIEGKKEIVIRYKLGKGTIGYLFTGKEKCEVKKNGNEYTLKDGIAAILDSIVDKHIRNLVENRLNRIFPDGETYRSEAEKALKEGREYNGEKRCKEALEQLKGLDDDPLFHDKDETRIIKSIRCKTGLNAVRPIRFNDNNEAITYVLPKNNHHVAIYRDENGKFIECVCTFWDAVGRVNQNIPCIISNIEEVWNDIHRREANGEYFSVEFKNTLPKEDWTFVESMQQNEMFVMDMDRETLERNIASGNYSVISQHLYRVQALSAGDYIFRIHTDTKSERTKEANLSKRFIRLSLKKFVASEHQKVQLSILGGITIAQ

SEQ ID NO: 1277 - protein, 891 aa, Unknown
  Description of Unknown: uncultivated organism with predicted taxonomy: Gammaproteobacteria bacterium
  MG16-196 effector
MKKVLGLDLGVGSIGWCLIEKDDNNTPKRILRMGSRIVPISSDEETGYTKGNAISKNADRTAKRTARKCYDRYQLRRKALVNLLKRLGMEPNENLMFEQTPIELWQKRADAASKEVSLEELGRVLLHINQKRGYKHSRISNSDSKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFNLEIDENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNSQNERENKEYAERIKEYGLTPTRNRIMKMRMWEESEYTCMYCGQPVNVVEFLKGADVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVEILLQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKR

SEQ ID NO: 1278 - protein, 1250 aa, Unknown
  Description of Unknown: uncultivated organism with predicted taxonomy: Bacteroides
  MG16-197 effector
MKNILGLDLGTTSVGWALIKAEDNNTPVEIQGMGVRIVPLAENEGDKFTRGQDVTVNADRTTARGIRRNYDRYQLRRQALTEKLRQLNMLPDENLIKLPVLELWQLRANAAKEKVTLSELGRVLYHLNQKRGYKHSQADKKDSKQRAYVKEINSRYTELNSLGMTIGQFFAQKLEETAVTHDGKTLFVYRIKDQIYPRQAYEEEYDIIMKCQQGFYPDILTDEVIDEIKNRIIYYQRDLRSCKHLVSICEFEKRCFYDAEGNVKRNEKGEIIYDGPKVAPRTSPLFQIFKNWQSINNIRFHNRRNEYLFISKEQRQVIAGVMDNAETLKLKDVQSVLGLTSKSGWYCDKAMKSGIKGNTTKCAILSALSSLPDSTIKDITRFNLETEETKNVDEETGEILLRIKNTYLDEPLYRLWHIIYSIKNVDERFNAIAKFLKEFNVEDASVVNALNDIDFVTPGYANLSSKAMCKMLPYLMDGLDYSDSCEYVGYNHSGSLTKEENANRELLNQIPALKKGELRQPTVEKILNQTINVFNQLSARLEKRGERIDEVRVELARELKQSKDERKEASDGIRKQQKRNEEYAKMLVEEGVRPTRNRILRYRLWEESNKRCFYCGQPISFNEFIKSSDAEREHVIPKALMFDDSFANQVCSCRECNKEKGGRTALDYMRTKSNLQAYLDRVDDMYQSHQIGGKKHSHLLASYDDYLSRKKEGKETKEDIMIWETPIERQLRLSQYISKKAQEILKTACREVVATSGTITDLIRHTWGYDTILHELNFPNYKEAGLTSFVTDEKTNQQREVIKDWSKRLDHRHHAVDALAVACTSRSIVQHINTLHASRDEMRKEVNSARKDWKDNNLLQQWIMEKKPFDRQYVLHKVASILVSMKAGKRTTVPGKRKVYKNGKPITIQTGLRIPRGQLHEQTIYGAIKQYDKDGKETTKIVTRYKVEDIFKGKETCDVVLDKKTNQYYINDEIEKALSYVVDKHIRDVIKERLNEAFPDGETYRSEAEKALVEGKPYKGENRCKQAFEQLKTLDEHPLYADKNKSIVIKKVRCYTGLSAVQPLRYNNNNDPISYVLTKNNHHVAIYADENGKYKECIYTFWQAVERSKYRLPLIIKDPKALWDEITQRENNGENFPDSLIKSLPMRDWTFIESLQSNDMFVMDMDDNDFEICISTNNYEELGKHIYRIQSISTLDYFFRLHTDTTSTTTPEAALSKRFIRIKSFKSYIAHNPHKIQVSLLGKIFTNQND

SEQ ID NO: 1279 - protein, 818 aa, Unknown
  Description of Unknown: uncultivated organism with predicted taxonomy: Bacteroidales
  MG16-198 effector
MKKVLGLDLGVGSIGWCLIEKDDNNTPKRILRMGSRIVPISSDEETGYTKGNAISKNADRTAKRTARKCYDRYQLRRQALVNLLKRLGMEPNKNLMFEQTPIELWQKRADAASKEVSLEELGRVLLHINQKRGYKHSRISNSDIKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFNLEIYENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYINRKALGKETDEDKELWENFIDRQLRQSQYIAKKSVDMLQQVCKNVYTTSGSVTDFVRHQWGYDELLHELNFERFKKAGLTAMVKQLHSGKEIEVERIKDWTKRLDNRHHAVDALAIACTTQGMIQRLNT

SEQ ID NO: 1280 - protein, 988 aa, Unknown
  Description of Unknown: uncultivated organism with predicted taxonomy: Gammaproteobacteria bacterium
  MG16-199 effector
MKKVLGLDLGVGSIGWCLIEKDDNNTPKRILRMGSRIVPISSDEETGYTKGNAISKNADRTAKRTARKCYDRYQLRRKALVSLLKRLGMEPNENLMFEQTPIELWQKRADAASKEVSLEELGRVLLHINQKRGYKHSRISNSDSKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQLREALSGLPKEQVDSLTAFNLEIYENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVDMLQQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKRTLAQTGIIVPRGALHAEFVYGRIMRQEADGVTMTPQYVRKYKLGIGAQGFLFKGDEVYKEEVKKNSKTGLSKIVVTDKIKDVLDKIVDGDIRQRILE

SEQ ID NO: 1281 - protein, 1233 aa, Unknown
  Description of Unknown: uncultivated organism with predicted taxonomy: Fibrobacter
  MG16-200 effector
MKKILGLDLGVGSIGWSVISVDENGDPSEILGMGSRIVPLSTDDANEFSTGNAISKNQKRTQKRTTRKGYDRYQLRRENLTAELRKHQMLPDEHLIKLPVLDLWTLRANAATEGQKLSLPEIGRVLYHINQKRGYKHAKADEAGEKKQTEYVENVNKRFAMIKDLGLTIGQFFARKLKESEVVSEKGKFYTYRTKEQVFPRGAYIAEFDQIIEVQRKFYPQVFTDEFINRLRNEIIFYQRNLKSCKHLVSLCEFEKHEYTNKDGKIVFDGPKVAPRTSPLFQICRIWEFVNNIRLENGYKEARTLSQDERLKVVDFLDNHEKMTAKDFTKLLGLNKNDEWDLKRYFGKNGTQGNTSKTQLATALANVPNASELLQFNLTLENSNYVNEKTGEVLKVVSSDFQNEPLYMLWHTVYSLSDKEELKNALNKKYGITDESVINNLFKIDFVKPGFGNKSAKAIRRILPFLQEGLVYSDACAEAGYNHSDSLTKSENEARTLLARLPQIKKNELRQPVIEKILNQMVNVVNAIYDEYGQIDEIRVELARELKQSKDERNTTASNIAKKERENKNIEAKIQEFGIRSSRNRIQKYRLWEESEQKCFYCGQPVQAKEFLSGLDVEVEHIIPKSLLFDDSFANKVCACRKCNADKGNKTAYDFMKGQKTEVFDAYVKRVNDFYKDGKISKTKKERLLTTQSEIPSDFIERQLRQTQYIAKKALEMLKDVCYNVYATSGSVTDFIRHTWGYDEILHQLNFDRYKKGGLTELREYDHKGETHTEERIQDWSKRLDHRHHAIDALVIAMTRQSIIQRLNHLNTERDAMFQEVEKQSKEWKNDYSMLQEWLRERKHFSTEDVAKKVSDILVSFKAGKRVATIGKRVKYEHGKKKVLQTGVVIPRGPLSEESVYGKIKVLDRNKPLKYLFENPQSIANADIKFAVTNRLAQYEHDVKKAVQSLKKSPIVLANGKNLENADCYKEEYVIKYSLNGFKAKDIDSVVDSHIKDVLYKRLEEYDGNEKEAFKDIEDNPIYADDAHKIKIRNVRCFTGLSAVVPVKKDENGNAISFVKPGNNHHVAIYKDENGTLQESVVTFWHAVERKKYGLPIIVTKPAEAWKLAIEKNCPKEFLDCLPKENWTFVESLQVNEMFVIGMNDEEFGNAIVDKDYALLNQHLYRVQKITTKEYCFRLHTETKVDDKYKGVKDAMKSKAMGKLKMIQSMDSWQKANPHKVKISLLGKLITRE

SEQ ID NO: 1282 - protein, 1242 aa, Unknown
  Description of Unknown: uncultivated organism with predicted taxonomy: Prevotella
  MG16-201 effector
MKRILGLDLGTNSIGWAVVNTDENDKPVSIENMGSRIVPLTSDDTNEFTKGNAITKNQARTVKRTARKGYDRYQLRREHLTAELRKLKMLPDERLIKLPVLELWELRGRAASKGNQLTLSEIGRVLYHINQKRGYKHAKSDESADTKQKAYVAEVNARYAKIKERNQTIGQFFAEKLKENEIETSKGKFYTYRIKEQVFPRKAYEAEFDQIMECQKEFYPDILTNEEINRLRNEIIFYQRRLKSCKHLVSFCDFEKREYINKVGKVVYGGPKVAPKSSPLFQICKIWEEVNNLTLKNRKNDELFITIDQRQAMVDFLDTHEKLTLSDMYSILGISKKDGWWGGKAIGRGLQGNTTKIALKKALGDFANADNLLQFNLKQTDSNLVDEVTGEILQVIDPKLEKEPLYDLWHTIYSISDKEELANALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFASIRVELARELKQSKDERNTTFLQNEAMQKLNESIATRLSSEGIKPTKRTIEKYKFIFPTKGCIDNRTGKFVTKNFDNLLTVNQCIYCGQPFSLSAALNGDGYEIEHIIPRDLICDNSQNNKVLSCRNCNSKKSNRTAFDFMRSQDNATFEAYLERVELWYQKGIISPAKRERLLLSYEDYLERKKKGKITDIDKKYWEDFVSRQAGETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIEASGIKYEEKKVLLDKYLTSLIPFKTQIVADAVNKILVSFKAGKKTATIGKRIEYKHGNKHIVQKGIIIPRGALHEEGVYGRIEINGKKEIVKKYKLGKGAQGFVFTGKETYAEKINKKTGGIQIEDKIKNVLDSIVDSNIRAKVLQRLNQGFEEGQDYRNNVKKALDNLNNLDENPIFADKNNTIPIRTVRCRTGLSAVVPIKKDERGEAIGFVKPGNNHHIAIYRDKEGKLKEHAVTFWHAVERKKYGIPVVIENPLEVWDSIRDKQLPETFLEKLPDINWTFEMSLQQNEMFVLGMEDDTFENAMRDKEYDLISNYLYRVQSISESDYWFRLHLETQNDKTTSAKLAKKYYRTKSIKGFYSLNPHKVYISVIGKIKEL

SEQ ID NO: 1283 - protein, 1155 aa, Unknown
  Description of Unknown: uncultivated organism
  MG16-202 effector
MNKKILGLDLGVGSIGWALIKTEDDMPKEIIGMGSRIVPLSKDDNDQFSKGQAITKNADRTARRTARKGYDRYQLRRALLTQVLRQNGMLPERMDEQVLDLWQLRSDAATEGCQLTLPQIGRVLYHINQKRGYKHAKSDDNGDSKQTKYVEAVNNRYADLQAAHQTIGQHFYEELYRSRVEREKGFYYTYRIKDQVFPRAAYIAEFDQIMHVQKAFYPDVLTDELIDTLRNRIIFYQRPLKSCKHLVSLCEFEMRPYKTKDGKVVYGGPKCAPRTSPLAQLCAMWETANNITLTNRNNEQLLISPEQRKQIVDFLCSHDVLKLTDLYKILGINKKDGWYGGKAIGKGIKGNATLNQLRAALNGKHAEWLEMPIEIEDKVDEVTGEVVKMVQSSVEQTPLFQLWHAVYSLQNADELAKTLREKFGIAEQEIINALCKIDFVKPGYANKSHKFIRRILPYLMDGYMYSEACEKVGIRHSNSMTVAERNTRSLRARIELLTKNSLRQPVVEKILNQMINLVNRLQQEYGTIDEARVELARELKQSRDERESAYKAMGQNERRNKEIAAKIAEFGIRPSRSRIQKYKMWEESQHRCFYCGEMMDLTQFLNGADVEIEHIIPRSILFDDSYSNKVCACRRCNQEKGNMTAMEYMEAKPSAEFEAYKQRVDDVFNKDHRISKTKRDHLLWRRADIPQDFIDRQLRQSQYIAKKAVEILKDGIREVWTSGGSVTDFLRHQWGYDEILHTLNLPRYQQVEGLTETIQYEHAGQTHEEERIKNWTKRIDHRHHAIDALTVALTQQAYIQRLNTLEASHDHMQKVVNEAGTQYNEKKSLLEKWVAEQPHFSVADVTDKVDGILVSFRAGKRVTTPARRAIYQGGKRTIVQTGIQVPRGALTEETVYGKLGDKFIVKYPLDHPSMKPENIVDPTIRALVQRRVAEKGKEAFNEPLCSAEGMKIKSVRCFTSLSEKGVVPVKHNEAGEPIGYAKKGNNHHIAIYQDKKGEYHEMVVSFWDAVERKKYGVPVVIEHPHELWDSLLDKELPQEFLAKLPLDDWQFILSMQENEMFVLGMEEDEFNDAIERQEYNTLNKHLYRVQKISHADYTFRYHTETKVDDKYEGIEKGRDTSLKLGALVSIRSFGSLFTKFPHKVKIDIMGRITRT

SEQ ID NO: 1284 - protein, 1003 aa, Unknown
  Description of Unknown: uncultivated organism with predicted taxonomy: Bacteroides sp. CAG:144
  MG16-203 effector
MKNILGLDLGTTSVGWALIQADDNNHPIAISDMGVRIVPLAENEGDKFTKGQDITVNADRTRARGIRRNYDRFQLRRNALTEKLRQLNMLPDEHLIKLPVLELWSLRANAVSQKVTLNELGRVLYHINQKRGYKHSRTDGTDSKQRAYVKDINDRYAELKNSGKTIGQLFAQKLSETAVSHDGKTFYVFRIKDQIFPRKAYEEEYDAVMKCQQQYYPQILTNEVIDEIRNRIIFYQRELRSCKHLVSVCEFEKRCFYDANHNVLRNNKGEVVYSGPKVAPRTSPLFQVFKNWQAVNNIRFHNRRNEYLYITKEQKQQMVNIMDHQEVLKLKDVHGVLGLSAKSGWYCDKSIKSGIKGNTTKLAILNALSSLPAENTKELTRFHLEFEETSLVDEETGEIIVQIKNNYLDEPLYRLWHIIYSIKDDAERYNAIVRFLAEFHVDAPDVAHSLKDIDFVTPGYANLSAKAICKILPYMMEGVGYSEACEFVGYNHSGSVTKAENDARELLEHIPAIKKNELRQPTVEKILNQMINVFNRINDNLKSNGERIDEVRIELARELKQSKEERDETSKGISKQQKLNDEYANLLKESGIRPTRNKITRYRLWREANETCFYCGQPVNFNEFVKFSEAEREHIIPKSLILDDSFANQVCSCRKCNAEKGGRTAIDYMRTTPYLQAYLTKVDEMFQGHKISGKKHAHLLASYEDYLVRKQQGKETKEDVNIWEAPIDRQLRLSQYITKKAHELLRTACRDVLATSGSITDLTRHVWGYDTILHELNLPRYKSAGITEVITDERTGREQEVIRDWNKRLDHRHHAIDALAVACTSRSMIQRINTLHASREEMREEVSSPRKDWKENDLLRQWIKEQRPFERQYVLHKVESILVSMKAGKKATVPGKRKVFKNGKPVVVQSGLRIPRGQLHEQTVYGAITLYDKTPEGRREIVARYKMGVGSVGFVFSGKESCDVVFDKKKEQYVLVDGIEKAINYIVDRHIRDIVRERLNEAF

SEQ ID NO: 1285 - protein, 1222 aa, Unknown
  Description of Unknown: uncultivated organism with predicted taxonomy: Bacteroidales
  MG16-204 effector
MKKVLGLDLGVGSIGWCLIEKDDNNTPKRILRMGSRIVPISSDEESGYTKGNAISKNADRTAKRTARKCYDRYQLRRQALVNLLKRLGMEPSKNLMLEQTPMELWQKRADAASKEISLEELGRVFLHINQKRGYKHSRLSNSDSKETAYVQEVNSRYDDLKAEGLTVGQHFAAKLKENEQETADGKKYYNYRIKEQVYPRHAYEEEVKKILEVQSRYHSDVLTPDVCKEILDIIFYQRDLKSCKNLVSLCEFESYTITKDGKEITIGPKVAPRTSPLAQLSSILETANNITIRNRRNDELYISPEQRRAIAEFLDNHEVMKLTDLYKMLNIGRKDGWWAGKAIGKGLKGNTTKCQIREALSALPKEQVDSLTAFQLEFDEYVDEETGEVRKRINNTLAEQQPLYKLWHMLYSIKDNDELSGALRHLGIEDEESIDKLCKCDFRTAGYANKSAKAIGRILPYLMEGVMYSDACERAGFDHSRRINSDRTLLTHLPQIQKNELRQPVVEKILNQLVNIVNALLEKEGAIDEIRVELARELKQSKDERNEAFRRNNQNERLNKELAERIKKYGLTPTRNRIMKLKMWEESEHSCMYCKQPVDPVEFLKGADVEREHIIPRALLFDNSFTNQVCSCRRCNSKKGMRTAYDFIADEKGQEGLNAYIEHINDLFDKKKISRSKLNRLLVSHKAYISRKAQGKETDEDKELWENFIDRQLRQSQYIAKKSVEMLQLVCKNVYTTSGSVTDFVRHQWGYDELLHELNFERFKKAGLTAMVKQMHSGKEIEVERIKDWTKRLDNRHHAVDALAIACTTQGMIQRLNTLNASREEMLEELSINDQRLIDPERSMLEKWLFVQPHISYAEAKNEINKIVISQRPNTRITVPGKRYVIKNGKRTLAQTGIIVPRGALHAEFVYGQIMKQEADGVTKTLQYVRKYKLGIGAQGFLFNGKEFYKEELKKDSKTGLSSIVVTDKIKDVLEKIVDGGIRQRILERLNRGFEEGADYRANVAQALANLKNLDEDPIYSDDAKTRPIRTVRKYVSSSTMVAVRKDGNGKPMSFVEPDGNHHVAFYKDENGVITESIVTKWLAVQRKLNHIPIIIDNPSQTWCEVLERNDVPEELLQSLPKDNSTFLLSLQIGEAFIMGMEDADYQKALLAKDVRTLCDHLFYVQNASSHDYRFRRHVEAKYDTNDMNKDDMRFLRIRTIDDLFNNNPHKVKVTVLGVIVE

SEQ ID NO: 1286 - protein, 1233 aa, Unknown; identical to SEQ ID NO: 1281
  Description of Unknown: uncultivated organism with predicted taxonomy: Fibrobacter
  MG16-205 effector

SEQ ID NO: 1287 - protein, 1011 aa, Unknown
  Description of Unknown: uncultivated organism with predicted taxonomy: Gammaproteobacteria bacterium
  MG16-206 effector
MKKVLGLDLGVGSIGWCLIEKDDNNTPKRILRMGSRIVPISSDEETGYTKGNAISKNADRTVKRTARKCYDRYQLRRKALVNLLKRLGMEPNKNLMFEQTPIELWQKRADAASKEVSLEELGRVLLHINQKRGYKHSRISNSDSKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFHLEIDEYVDEETGEVRKRINNTQAEQQPLYKLWHMLYSIKDNNELAGALNHLGIEDEESIEKLCKLDFRTVGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVEILQQVCKDVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKRTLAQTGIIVPRGALHAEFVYGRIMRQEADGVTMTPQYVRKYKLGIGAQGFLFKGDEVYKEEVKKNSKTGLSIIVVTDKIKDVLDKIVDGDIRQRILERLNRGFEEGVDYRANVPQALANL

SEQ ID NO: 1288 - protein, 957 aa, Unknown
  Description of Unknown: uncultivated organism
  MG16-207 effector
MKNILGLDLGTTSVGWALIQSDDNNHPITISDMGVRIVPLAENEGDKFTKGQDITVNADRTRARGIRRNYDRFQLRRNALTEKLRQLNMLPDEHLIKLPVLELWSLRANAVSQKVTLNELGRVLYHINQKRGYKHSRTDGTDSKQRAYVKDINDRYAELKSSGMTIGQLFAQKLSETAVSHDGKTLYVFRIKDQIFPRKAYEEEYDAVMKCQQQYYPQILTNEVIDEIRNRIIFYQRELRSCKHLVSVCEFEKRCFYDANHNVLRNNKGEVVYSGPKVAPRTSPLFQVFKNWQAVNNIRFHNRRNESLYITKEQKQQMVDIMDRQEVLKLKDVHEVLGLTAKSGWYCDKSIKSGIKGNTTKLAILNALSPLPAEKTKELTRFHLEFEETSLVDEETGEIIVRIKNNYLDEPLYRLWHIIYSIKDDAERYNAIVRFLAEFHVDAPEVANSLKDIDFVTPGYANLSAKAICKILPYMMEGVGYSDACEFVGYNHSGSMTKAENDARELLEHIPAIKKNELRQPTVEKILNQMINVFNRINDNLKSNGERIDEVRIELARELKQSKEERDETSKGISKQQKLNDEYANLLKGKGIRPTRNKITRYRLLMESNETCFYCGQPVNFNEFVKFSEAEREHIIPKSLILDDSFANQVCSCRKCNAEKGGRTAIDYMRTTPHLQAFLSKVDEMFQGHKISGKKHAHLLASYEDYLVRKKQGKETKEDVNIWETPIDRQLRLSQYITKKAHELLRTACRDVLATSGSITDLTRHVWGYDTILHELNLPRYKSAGITEVITDERTGREQEVIKDWNKRLDHRHHAIDALAVACTSRSMIQRINTLHASREEMREEVSSPRRDWKENDLLRQWIKEQLPFERQYVLHKVESILVSMKAGKKATVPGKRKVFKNGKPVVVQSGLRIPRGQLHEQTVYGAITLYDKAPEGRREIVARYKMGVGSVGFVFL

SEQ ID NO: 1289 - protein, 1234 aa, Unknown
  Description of Unknown: uncultivated organism
  MG16-208 effector
MYLCSRKTNKTLYNMKKVLGLDLGVSSIGWALITKDNNNQPIDILKIGSRTVPLLDGEEEGFSNGNGISANSSRTQKRTARKCNNRYKLRREKLTDGLRALNMLPNAMLFNLNPLELWQLRAKAVTDKVSLPELGRILFHLNQKRGYKHSKDNEQDSKQTEYVATINKRYIDLQEKGLTIGQYFAQKLKESEKIQENGVCYTYRIKDQVYPRAAYEEECHKILLNQQRFYPEVLTDDVIKDFFNFIYYQRPLKSCKHLVSRCELEKQLLSSDDDVANYAPKVAPLSSPLAQLDKIWEAVNNFTIRDKRNDELFITLEQRKEIVNYLQEHLTINRSKMREILGISKTKRWFIKADNLRVLQGNKTRIKIAEALSKGDLSQEEINGYLRFDLGYDCQVDTQTGEIAATIIKATFEEQPLYQLWHYIYSIPEERDLKNKLMKFGIHDETVLDALCGISFKTIGYAKKSTRAIRKILPYLAEGFKYSEACYLAGYNHSNSITKDEEANRKLKEYIPQIQKNELRQPVVEKILNQMINIVNSLLKDGPINEIRVELARELKQSKDEREKTSKDIRANKKKNDECAERVKEYGFSPTRNRIMRYKMWVETNHRCIYCNDGVNVKDFLSGVDVEREHIIPKALLFDDSFSNQTCSCRKCNRDKGSRTALDYIRDCGREEEYITRVNELLEKRQISKTKYNHLLTSYRDYLERKTQGKETQEDKDLWEHFIDRQLRQSQMIARKSFEVLRQICHNVYATSGSVTDFLRHQWGYDNILHDLNFERFSKSDNIEEITIVGRDGIETKVKRIKGWNKRIDNRHHAVDALTIALTTQSMIQRLNTLYASRDAMHGDIEASKQKFNEKKSILEKWTAIQPHFTYSQASEAISRILISQRGGKRITTPGKRYEFKGGKKILKQTGIVVPRTALHDEFIYGQISRYDAKGLLTKEIVRKYGIFGGMGCLFTGKETYKEETVSDKKTGISTIKISDGIKDVLDKIVDGGVRKRILERLNRGFEEGKDYRSDTKKALDNLRHLDEDPIFLDDARTIPIKTVRKFTHSTKAIPLRYNDSHQPIAFVEPGGNHHVALYKAPDGTIKEHICTNWHAVQRRLFGLPAIIDKPSEIWVKALENDKFPEDLLSHLPEENLNFIVSLQIGDAFILGMEEEEYQQAISNNNYKLLSEKMYYIQNLSSLNYRFRRHVEAQFDTHQMNKEDLRFYNIKSIGAFFNLNPHRVNVSLIGEIIV

SEQ ID NO: 1290 - protein, 911 aa, Unknown
  Description of Unknown: uncultivated organism with predicted taxonomy: Chryseobacterium vrystaatense
  MG16-209 effector
NLTIMKRILGLDLGTNSIGWAVVNTDENDKPVSIENMGSRIVPLTSDDTNEFTKGNAITKNQARTVKRTARKGYDRYQLRREHLTAELRKLKMLPDERLIKLPVLELWELRGRAASKGNQLTLSEIGRVLYHINQKRGYKHAKSDESADTKQKAYVAEVNARYAMIKERNQTIGQFFAEKLKENEIETSKGKFYTYRIKEQVFPRKAYEAEFDQIMECQKEFYPDILTNEEINRLRNEIIFYQRRLKSCKHLVSFCDFEKREYINKVGKVVYGGPKVAPKSSPLFQICKIWEEVNNLTLKNRKNDELFITIEQRQAMVDFLDTHEKLTLNDMYSILGISKKDGWWGGKAIGRGLQGNTTKIALKKALGDIANADNLLQFNLKQTDSNLVDEVTGEILQVIDPKLEKEPLYDLWHTIYSISDKEELANALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFASIRVELARELKQSKDERNTTFLQNEAMQKLNESIATRLSSEGIKPTKRTIEKYKFIFPTKGCIDNRTGKFVTKNFDNLLTVNQCIYCGQPFSLSAALNGDGYEIEHIIPRDLICDNSQNNKVLSCRNCNSKKSNRTAFDFMRSQDNATFEAYLERVELWYQKGIISPAKRERLLLSYEDYLERKKKGKITDIDKKYWEDFVSRQAGETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIEASGIKYEEKKVLLDKYLTSLIPFKTQIVADAVNKILVSFKAGKKT

SEQ ID NO: 1291 - protein, 1152 aa, Unknown
  Description of Unknown: uncultivated organism
  MG16-210 effector
MKKILGLDLGVASIGWALIEADEQNAPKSILAMGSRIVPLSTDDATEFSQGKAISKNRNRTQKRTQRKGYDRYQMRRAALTEELRAHHMLPDEILIKLPVLELWQLRADAATRQLTLPEIGRVLYHINQKRGYRHAKSDSDEEKAQRDYVQAVNDRYAELKAEGKTIGQHFADKLKENCIITEKGPFYTYRIKEQVYPRAAYMEEFDLVIACQKEFYPEVFTDAFINRLRNEIIFYQRSLKSCKHLINQCEFSQRAYKKADGSIVIAGPKVAPRTSPLFQICKIWESVNNLKLTNRKGEEYPFTLSQRKELVEFLDEHEKLTLTDLYKIIGVKKNDGWWGGKAIGKGLQGNTTKCLIKKALGDKYADLLRFDLHIIESKNIDTETGEVLEIISPGLEKEPLFRLWHILYSMQDKDEMAAALHRQFGITEEDIIDALYKIDFVKPGYGNKSSRFMREILPYLQKGMMYSDACNYIGINHSNSITSEENAVRELKSRLPQLQKNELRQPVIEKVLNQMVNVVNALLDKYGEIDEIRVELARELKQSKDERNEVFLRNNKRERENAEIIKRIEEYGVRPSRSRIQKYRLWEESNQICFYCGNTVGVKEFLSGVDAEIEHIIPRSLFFDDSFSNKVCACRACNQEKGNRTAYDYMQSKSEIEFDNYLRRVENYYNEKKISKTKRERLLTAAKDIPQDFLDRQLRQSQYISKKAIEMLKQICRYVWATSGSVTDFIRHNWGYDKILHDLNFERYKSGGLTEMVHYDHQGQEHDEERIKEWTKRLDHRHHALDALTIASTQQGYIQRLNHLNTERDQMFAELEMQREEYKGRYSLLEEWIKERPHISVEDAKVAVDQIAVSFKAGKKVATPGKRYIYKSGKRILAQDGILVPRGALSEESVYGSISTIERNVPAKNLFEHPERIFKGYIRKLVEERIAECGGDWKKARASINKRPIFLDDEGQKKLEYATCWKEESVFHYPIKSIKKNDVDWIVDGHIREIIRKRIEEVGEKNAFNEPIYADKACNIPIRHVRMFTGLSAVEPIKYVDGQPVGFVKPGNNHHIAIYVDTQGNKVEQAVTFWHALERKKYGFPVIIDDTDTVWEKVDQMDLPEAFIKNLPEPGLKLYTSLQQNEMFILGMGEDEYNDAVAAKDYKSLCK

SEQ ID NO: 1292 - protein, 1242 aa, Unknown
  Description of Unknown: uncultivated organism with predicted taxonomy: Prevotella
  MG16-211 effector
MKKILGLDLGTNSIGWAVVNTDDNGIPTHIEGMGSRIVPLSPDDTNEFTKGNAITKNQSRTEKRTARKRYDRYQLRRENLTAELRKLKMLPDEKLIKLSVLELWELRGKAASKGNQLTLSEIGRILYHINQKRGYKHAKSDENADTKQKAYVAEVNARYAMIKERNQTIGQFFAEKLKENEIETPKGKFYTYRIKDQVFPRKAYEAEFDQIMECQKEFYPEILTEKVINKLRNEIIFYQRKLKSCKHLVSICDFEKQEYINKDGKSIYRGPKVAPKSSPLFQICKIWEEVNNLSLKNRKNDELFITLEQRQAMVNFLETHEKLTLSDMYSILGISKQDGWWGGKAIGKGLKGNVTKIALKNALGDFENADRLLQFNLKQIDSNLVDEVTGEILQVIDPKMEKEPLYDLWHTIYSISDKEELANALKKKYNIHDEDVINRLYSIDFVKSGFGNKSSKAMRRILPYLQQGLKYSDACEYAGFRHSDSLTKAENDARQLLEKLPPIQKNTLRQPIVEKILNQMINVVNALMIEYGQFDSIRVELARELKQSKDERNTTFLQNEAMQRLNESIAKRLSFEDIKPTKRTIEKYKFIFPTKGCIDKRTGKFVTKSFDGLSTINQCIYCGQPFSLSAALNGDGYEIEHIIPRDLLCDNSQNNKVLSCRKCNSRKSNKTAFDFMRSQDESIFEEYLERIELWYKNGIISPTKREHLLLSHEDYLERKKKGKVTDIDKKYWEDFVSRQVGETQYISRESIRILKQCCRTVNATSGKITAILRHLWGYDEILHQLNFERYKKAGLTETKTWESNHGKNKHSKEQIVDWSKRIDHRHHAIDALVVACTQQGVIQRINTLNADETKDLMKKQIESANIKYEEKKVLLDKYLTSLVPFNTKTVAEAVNKILVSFKAGKKTATVGKRIEYKHGKKHIVQKGIIIPRGALHEEGVYGKIEINGKKEIVKKYKLGKGAQGFVFTGKETYAEKVNKKTGAIQIEDKIKDVLDSIVDGNIRAKILQRLNRGFVEGEDYRNNVKQALDNLNNLDENPIFADDNNNIPIRTVRCRTGLSAVEIIKRNEGGEAIGFVKPGNNHHIAIYRDKEGKLKEHAVTFWHAVERKKYGIPVVIENPLEVWDSIRDKQLPETFLEKLPDINWTFEMSLQQNEMFVLGMEDDTFENAMRDNDYAKLGQYIYKVQNISEKQYRFSLHTATKFDVKRMNKTDKSFYNIRSLDALFALHPHKVYISVIGKIKEL

SEQ ID NO: 1293 - protein, 1224 aa, Unknown; identical to SEQ ID NO: 1243
  Description of Unknown: uncultivated organism with predicted taxonomy: Prevotella ihumii
  MG16-212 effector

SEQ ID NO: 1294 - protein, 1217 aa, Unknown
  Description of Unknown: uncultivated organism with predicted taxonomy: Treponema pedis
  MG16-213 effector
MKKILGLDLGVASVGWALIEADEQNAPKSILAMGSRIVPLSTDDATEFSQGKAISKNRNRTQKRTQRKGYDRYQMRRAALTEELRANDMLPDETLIKLPVLELWQLRADAVTRQLTLPEIGRVLYHINQKRGYRHAKSDSEEEKSQRDYVQAINDRYAELKAEGKTIGQHFADKLKENCIITEKGPFYTYRIKEQVYPRAAYMEEFDRVISCQKGFYPTVFTDAFINRLRNEIIFYQRNLKSCKHLINQCEFSQRAYKKADGSIVIAGPKVAPRTSPLFQICKIWECVNNLRLTNRKGEEYPFTLEQRKELVDFLDNHEKLTLSDLYKILGIRKSDGWYGGKAIGKGLQGNTTKCLIKKALGDKYADLLRFDLQTIGSKSIDTETGEVLEIISPELEKEPLFRLWHILYSMQDKDEMAAALQRQFGITEGDIIDALYKIDFVKPGYGNKSSRFMREILPYLQKGMMYSDACNYIGINHSNSVTSEENAVRELKSRLPQLQKNELRQPVIEKVLNQMVNVVNALLDKYGEIDEIRVELARELKQSKDERNEVFLRNNKRERENAEITKRIEEYGIRPSRSRIQKYRLWEESNHICFYCGQPVGAKEFLSGVDVEIEHIIPRSLFFDDSFSNKVCACRKCNQDKGNSTAFDFMKAKPEVEFDNYLRRVESYYNEKRISKTKRDRLLTAAKDIPEDFINRQLRQSQYISKKAVEMLKQVCRYVWTTSGSVTDFLRQTWGYNNILHDLNFERYKSGGLTEIRQYDHKGQEQSKECIIGWTKRLDHRHHALDALTIASTQQGYIQRLNHLNTERDEMFAELKKQSEEHKEKHSLLEDWMKERPHLSVEAVKEAVDQIAVSFKAGKKVATPGKRYIYKGGKRVLAQDDILVPRGALSEESVYGSISTIERNVPAKNLFEHPERIFKGYIRKLVEERIAEYGGDWKKARASLNKRPIFLDDKGQRKLEYATCWKEEMVLRYPIEKIDKGKVDKIVDSHILDIIRKRIEEAGEKNAFKEPIYADEACTIPIRHVRLFTGLTAVEPIKYADGQPVGFVKPGNNHHIAFYVDAQGNKSEHVVTFWHALERKKYGFPIIIEDTDAVWEKVDQMDLPEAFVRNLPEPGLKLDMSLQQNEMFILGMGEDTYRDAMAAKDYKTLCKHLYRVQNIANLDYYFRLHIDTSDDKSNEAQKIKKFYRVRSISSLMDLNPKKVKISILGEIFPLDD

SEQ ID NO: 1295 - protein, 1224 aa, Unknown
  Description of Unknown: uncultivated organism with predicted taxonomy: Sediminibacterium sp. C3
  MG16-214 effector
MKKVLGLDLGVGSIGWCLLEKDDKNVPIRIIRMGSRIVPISTDEETGFTKGNAISKNADRTAKRTARKCYDRYQLRRQALVNLLRRLGMEPSKNLMLEQTPMELWQKRADAASKEISLVELGRVLLHINQKRGYKHSRLSNSDSKETAYVQEVNSRYDDLKAEGLTVGQHFAAKLKENEQLSAAGKKYYNYRIKEQVYPRCAYEEEVKKILEVQSQYHSDVLTADACKEMMDIIFYQRDLKSCKNLVSLCEFESYTITKNGKEITIGPKVAPRTSPLAQLSSILETANNITIRNKRNDELYISPEQRKAIADFLDTHEVLKLSDLYKILNIGRKDGWWAGKAIGKGLKGNTTKCQIRKALSKLPKDLVDSLTAFQLEFEECVDQETGEVRKRINNTLVEKQPLYHLWHLIYSIKDVDELSGALRHLGIEDEESIRNLCDLDFRTAGYANKSAKAIGRILPYLMEGVMYSEACERAGFDHSRRIDPNRTLLKHLPPIQKNELRQPVVEKILNQLVNIINALIEKEGAIDEIRVELARELKQSKDERNETFKRNNQNERQNKEYAERIKEYGLTPTRNRIMKMKMWEESEYTCMYCGQPVNVTEFLKGADVEREHIIPRGLLFDNSFTNQVCSCRRCNSKKGMRTAYDFIADDKGQEGLNAYIDRINDLFDKKKISRSKLNRLLVSHKAYISRKAQGKETEEDKELWENFIDRQLRQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWIVVQPHISYSEAKNEIDKIVISQRPNTRMTVPGKRYVTKNGKRTLAQTGIVVPRGALHAEFVYGRIMKQEPDGITMTPQYVRKYKLGIGAQGFLFNGKEFYKEELKKDSKTGLSKIVVTDKIKEVLDKIVDGGIRQRILERLNRGFEEGADYRANVAQALTNLKNLDEDPIYSDDAKTRPIRTVRKYVSSSTMVAVRKDDKGKPVAFVEPDGNHHVAFYKNENGVISETIVTKWQAVQRKVNHIPIIIDNPSQTWSKVLGRNNVPEELLQSLPRDSSSFLLSLQIGEAFIMGMEEAEFQKALEEKDMQTLAEHLYFVQNISSNNYRMRRHVESSFDTTDMNKEDQRFFNIQSISSFFNSNPHKVKITILGDIVVDV

SEQ ID NO: 1296 - protein, 1222 aa, Unknown
  Description of Unknown: uncultivated organism with predicted taxonomy: Prevotella
  MG16-215 effector
MKKVLGLDLGVGSIGWCLIEKDDNNTPKRIIRMGSRIVPISSDEETGYTKGNAISKNADRTAKRTARKCYDRYQLRRQALVNLLKQLGMGPSKNLMLEQTPIELWQKRADAASKEITLEELGRVLLHINQKRGYKHSRLSNSDSKETAYVQEVNSRYDDLKAEGLTIGQHFAAKLKENEQESADGKRYYNYRIKEQVYPRHAYEEEAKRILEVQSRYHSDVLTSDVCKEMMDIIFYQRDLKSCKNLVSLCEFESYTITKDGKEITIGPKVAPRTSPLAQLSSILETANNITIRNRKNDELYISPEQRKAIADFLDNHEVMKLTDLYKILKIGRKDGWWAGKAIGKGLKGNTTKCQIREALSALPKEQVDSLTAFQLEIDEYVDEETGEVRKRINNTKAEKQPLYRLWHLLYSIKDVDELSGALHNLGIEDEESIEKLCNLDFRTAGYANKSAKAIGRILPYLMEGVMYSDACERAGFDHSRRINPDRVLLTHLPQIQKNELRQPVVEKILNQLVNIVNALLEKEGTIDEIRVELARELKQSRDERNETFKRNNQNERQNKVYAERIKEYGLTPTRNRIMKMKMWEESEYTCMYCGQPVNVTEFLKGADVEREHIIPRGLLFDNSFTNQVCSCRRCNSKKGMRTAYDFIADDKGQDGLNAYIDRINNLFDKKKISRSKLNRLLVSHKAYISRKAQGKETDEDKELWENFIDRQLRQSQYIAKKSVEMLQQVCKNVYTTSGSVTDFVRHQWGYDDLLHDLNFERFKKAGLTAMVKQLHSGKEVEMERIKDWTKRLDNRHHAVDALAIACTTQGMIQRLNTLNASRDEILEELNSKDQRVVDPERSMLEKWVYAQPHISYAEAKNEIDKIVISQRPNTRITVPGKRYVTKNGKRTLAQTGIIVPRGALHAEFVYGRIMKQEADGVTMTPQYVRKYKLGIGTQGFLFKGDEVYKEELKKDSKTGLSKIVVTDKIMDVLEKIVDGGIRQRILERLNRGFEEGTDYRANVAQALANLKNLDEDPIYSDDAKTRPIRTVRKYVSSSTMVAVRKDSNGKPISFVEPDDNHHVAFYMYQDGERTESVVTKWQAVQRKLNHIPIIIDNPSQTWNEVLGRNDVPDELLQSLPQDKSIFLLSLQKGEAVVMGLEEMNYQRALEKKDMRTLCNHLFYVQSASSHDYRFRRHVEAKYDTKDMNKDDMRFLRIRTVDELFKNNPHKVKVTVLGDIVE

SEQ ID NO: 1297 - protein, 1222 aa, Unknown
  Description of Unknown: uncultivated organism with predicted taxonomy: Bacteroidales
  MG16-216 effector
MKKVLGLDLGVGSIGWCLIEKDDDNTPKRIIRMGSRIVPISSDEETGYTKGNAISKNADRTAKRTARKCYDRYQLRRQALVNLIKRLYMLPNKELMLEQTPLEIWQKRADAASKEITLEALGRVLLHINQKRGYKHSRLSNADRKETAYVQEVNSRYDELKAEGLTIGQHFAAKLKENEQTSNDGKKYYNYRIKEQVYPRHAYEEEVKKILEIQSQFHADVLTPDVCREIMDIIFYQRDLKSCKNLVSLCEFESHTITKDGKEITIGPKVAPRTSPLAQLSSILETSNNITIRNRRNDELYISPEQRKAIADFLDNHEVMKLTDLYRILNISRKEGWWAGKAIGKGLKGNTTKCQIREALGSLPKEQVDSLTAFRLEFEEYVDEETGEVRQRVNNTLAEQQPLYKLWHMLYSIKDNKELSGALHHLGIDDEKSINKLSNLDFRTAGYANKSAKAIGRILPYLMDGIMYSEACERAGFDHSRRINPGRTLLTSLPQIQKNDLRQPIVEKILNQLVNIVNALLEKEGTIDEIRVELARELKQSKDERNEAFKRNNQNERQNKEYAERIKEYGLTPTRNRIMKMKMWEESEYTCMYCGQPINVTEFLQGADVEREHIIPRALLFDNSFTNQVCSCRRCNSQKGMRTAYDFIADDKGQEGLDLYIERINDLFDRKKISRSKLNRLLVSHKAYVSRKAQGKETEEDKELWENFIDRQLRQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLSACRNEMLDELNSKDERVIDPERSMLEKWINSQPHICYAQAKDEVDKIIVSQRPNTRITVPGKRYVTKNGKRTQAQTGIIVPRGALHAEFVYGRIMKQEADGMTLTPQYVRKYKLGIGAQGFLFKGDETYKEDVKKDKKTGLSQIVVTDKIKDVLDKIVDGGIRRRILERLNRGFEEGTDYRANVAKALANLKNLDDDPIYSDDAKTRPIRTVRKYVSSSTMVAVRKNDDGKPISFVEPDGNHHVAFYKDEDGVVTESLVTKWQAVQRKLNHIPIIIENPSQVWNEVLGTNDIPNELLQSLPKDKSIFLLSMQIGEAFVMGMDETAYKRAIEKNDTQALADHLYFVQNLSSNNYRLRRHVESSFDTTDMNKEDLRFLNVKSIGALFNYNPHKVKLTILGDIIL

SEQ ID NO: 1298 - protein, 917 aa, Unknown
  Description of Unknown: uncultivated organism with predicted taxonomy: Porphyromonas catoniae
  MG16-217 effector
MKKVLGLDLGVGSIGWCLIEKDDNNTPKRILRMGSRIVPISSDEETGYTKGNAISKNADRTTKRTARKCYDRYQLRRQALVNLLKKLGMEPSKNLMLEQTPMELWQKRADAASKEVSLDELGRVLLHINQKRGYKHSRLSNSDSKETAYVQEVNSRYKDLKAEGLTIGQHFAAKLKENEQETADGKKYYNYRIKEQVYPRHAYEEEVKKILEVQSQYHSDLLTSDVCKEIADIIFYQRDLKSCKNLVSFCEFESYAITKDGKEITIGPKVAPRTSPLAQLSSILETANNITIRNRKNDELYISPEQRKAIADFLDNHEVMKLTDLYKILNIGKKDGWWAGKAIGKGLKGNTTKCQIREALANLPKEQVDSLTVFQLDIDNYVDEETGEVRQRINNTKAEKQPLYRLWHLLYSIKDVDELSGALRHLGIEDEESIEKLSKLDFRTAGYANKSAKAIGRILPYLMEGMMYSDACERAGFDHSRRINPDRALLTYLPQIQKNELRQPVVEKILNQLVNIVNALLDKEGAIDEIRIELARELKQSKDERNEAFKRNNQNERQNKEYAERIKVYGLTPTRNRIMKMKMWEESEYTCMYCGQPVNVTEFLQGADVEREHIIPRGLLFDNSFTNQVCSCRRCNSKKGMRTAYDFIADDKGQEGLDAYIDRINDLFNKKKISRSKLNRLLVSHKAYIIRKTQGKETEEDKELWENFIDRQLRQSQYIAKKSVEMLQQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYVAKNGKRTLAQTGIIVPRGALHAEFVYGRIMKQ

SEQ ID NO: 1299 - protein, 1224 aa, Unknown
  Description of Unknown: uncultivated organism with predicted taxonomy: Prevotella
  MG16-218 effector
MKKVLGLDLGVGSIGWCLIEKDDNNTPRRILRMGSRIVPISSDEESGYTRGNAISKNADRTAKRTARKCYDRYQLRRQALVNLLKKLGMEPNKNLMFEQTPLELWQKRADAASKEITLEELGRVLLHINQKRGYKHSRLSNSDSKETAYVQEVNSRYVVLRAEGLTVGQHFAAKLKENEQESADGKKYYNYRIKEQVYPRHAYEEEVKKILEVQSQYHSDVLTSDVCKEIGDIIFYQRDLKSCKNLVSFCEFESYTIKKDGKKITIGPKVAPRTSPLAQLSSILETANNITIRNRRNDELYISPEQRKAIAEFLDNHEVMKLTDLYKILNIGKKDGWWAGKAIGKGLKGNTTKCQIREALSGLPKEQVDSLTAFKLEIDECVDEETGEVRKRIDNTKAEKQPLYRLWHLLYSIKDNDELTGALRHLGIENKEIIEKLCKIDSRTAGYANKSAKAIGRILPYLMDGVMYSEACGRAGYDHSRRVNPDRVLLTHLPQIQKNELRQPVVEKILNQLVNIVNALLEKEGAIDEIRVELARELKQSKDERNEVFKRNSQNERKNKEYAERIKEYGLTPTRNRIMKMRMWEESEYTCMYCGQPVNVSEFLKGADVEREHIIPRGLLFDNSFTNQVCSCRRCNSKKGMRTAYDFIADEKGQEGLDIYIDRINDLFNRKKISRSKFNRLMASHKAYMRRKAQGKETDEDKELWENFIDRQLRQSQYIAKKSVEMLQQVCKNVYTTSGSITDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTRITVPGKRYVIKSGKRTLAQTGIIVPRGALHAEFVYGRIQKQEADGDTKTYQYVRKYKLGIGAQGFLFNGKEFYKEELKKDSKTGLSSIVVTDKIKDVLDKIVDGGIRQRILERLNRGFEEGADYRANVARALENLKNLDEDPIYSDDAKTRPIRTVRKYVSSSTMVAVRKDSNGKAISFVEPDGNHHVAFYKDENDVITENIVTKWLAVQRKLNHMPIIIDNPSQTWSEILKRNDVPEELLQSLPKDSSTFLLSLQIGEAFIMGMEDGDYQKALEEKDMQTLADHLYFVQNISSNNYRLRRHVESSFDTTDMNKEDQRFLNIKSVNSFFNSNPHKVKITILGDIITDV

SEQ ID NO: 1300 - protein, 1228 aa, Unknown
  Description of Unknown: uncultivated organism with predicted taxonomy: Fibrobacter
  MG16-219 effector
MKKILGLDLGVGSIGWSVISVDENGDPSEILGMGSRIIPLSTDDANEFSTGNAISKNQKRTQKRTARKGYDRFQLRRENLTAELRKLHMLPDEKLIKLPILELWTLRAKAATEGNKLSLPEIGRILYHINQKRGYKHAKADEAGDKQQTEYVAAVNSRYAMIKERCQTIGQYFAEKIRESEVISEKGKFYTFRTKEQVFPRKAYEEEFDKIIAVQRQYYPDVLTDSAINRLRNEIIFYQRNLKSCKHLVSLCEFEKHEYKNKEGQIVYDGPKVAPRTSPLAQICRIWEFVNNISLENGYKERRELSLEEKQKVIHFLDNNEKMTATDFSKLLGLGKKNEWDLKRYFGKNGVKGNETKVSLRNALKDFPNVEELLQFNLTLDNSNYVNESTGEVLKVISPSFQNEPLYDLWHTVYSLSDKDELSNALGKKFGISDKNAIQQLFKIDFVKPGFSNKSAKAVRRILPFLQQGLMYSEACAEAGYNHSNSLTKTENEARSLLDRLPQIKKNELRQPVVEKILNQMVNVVNAIYDDYGTIDEIRVELARELKQSKDERNTTFNNIAKRERENKGIAERIKNEYGLIPNRNKIEKYRLWEEAEQKCFYCGQTVNVKEFLSGFDVEVEHVIPKSLLFDNSYANKVCACRKCNANKGNKTAFDFMKSQSEDAFNNYVSRVEEYYKNGKISRTKHDRLLTPQSEIPSDFIERQLRQTQYISKKALEMLKEVCCKVYATNGSVTDFIRHTWGYDEILHQLNFDRYKQGGLTEVREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKRVATTGKRIKYEKGQKKVLQEGIVIPRGALSEESVYGKIKVIDPHKPLKFLFENPQTIVSPQIKTAVIDRLSKFGNDVKKAIASIKKEPLTLASDKVINDADCFKEEYVIKYPLEGFKAKDIQFVVDKHIREDVLPKRLAEFDGNEKNAFKNIDKNPIFADANHNIPIKHVRCFTGLSAVVPVKHDDAGKAIGFVKPGNNHHVAIYKDECGKLHESLVSFWNAVERKIKKVPVVITQPQDAWNIAENAHCSEEFTASLPNKTWTFVQSLQVNEMFVLGLEESAYQKAVREKDYNLINKHLYRVQSISKSDYFFRHHLETIIDDTSASKEMKRFYRFKSLGSFFKENPHKVQISVLGKLIVKE

SEQ ID NO: 1301 - protein, 1222 aa, Unknown
  Description of Unknown: uncultivated organism with predicted taxonomy: Sediminibacterium sp. C3
  MG16-220 effector
MKKVLGLDLGVGSIGWCLIEKDDDNTPKRIIRMGSRIVPISSDEETGYTKGNAISKNADRTAKRTARKCYDRYQLRRQALVNLIKRLYMLPNKELMLEQTPLEIWQKRADAASKEITLEALGRVLLHINQKRGYKHSRLSNADRKETAYVQEVNSRYDELKAEGLTIGQHFAAKLKENEQTSNDGKKYYNYRIKEQVYPRHAYEEEVKKILEIQSQFHADVLTPDVCREIMDIIFYQRDLKSCKNLVSLCEFESHTITKDGKEITIGPKVAPRTSPLAQLSSILETSNNITIRNRRNDELYISPEQRKAIADFLDNHEVMKLTDLYRILNISRKEGWWAGKAIGKGLKGNTTKCQIREALGSLPKEQVDSLTAFRLEFEEYVDEETGEVRQRVNNTLAEQQPLYKLWHMLYSIKDNKELSGALHHLGIDDEKSINKLSNLDFRTAGYANKSAKAIGRILPYLMDGIMYSEACERAGFDHSRRINPGRTLLTSLPQIQKNDLRQPIVEKILNQLVNIVNALLEKEGTIDEIRVELARELKQSKDERNEAFKRNNQNERQNKEYAERIKEYGLTPTRNRIMKMKMWEESEYTCMYCGQPINVTEFLQGADVEREHIIPRALLFDNSFTNQVCSCRRCNSQKGMRTAYDFIADDKGQEGLDLYIERINDLFDRKKISRSKLNRLLVSHKAYVSRKAQGKETEEDKELWENFIDRQLRQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLNACRNEMLDELNSKDERVIDPERSMLEKWINSQPHICYAQAKDEVDKIIVSQRPNTRITVPGKRYVTKNGKRTQAQTGIIVPRGALHAEFVYGRIMKQEADGMTLTPQYVRKYKLGIGAQGFLFKGDETYKEDVKKDKKTGLSQIVVTDKIKDVLDKIVDGGIRRRILERLNRGFEEGTDYRANVAKALANLKNLDDDPIYSDDAKTRPIRTVRKYVSSSTMVAVRKNDDGKPISFVEPDGNHHVAFYKDEDGVVTESLVTKWQAVQRKLNHIPIIIENPSQVWNEVLGTNDIPNELLQSLPKDKSIFLLSMQIGEAFVMGMDETAYKRAIEKNDTQALADHLYFVQNLSSNNYRLRRHVESSFDTTDMNKEDLRFLNVKSIGALFNYNPHKVKLTILGDIIL

SEQ ID NO: 1302 - protein, 1018 aa, Unknown
  Description of Unknown: uncultivated organism with predicted taxonomy: Sediminibacterium sp. C3
  MG16-221 effector
MKKVLGLDLGVGSIGWCLIEKDDNNTPKRILRMGSRIVPISSDEESGYTKGNAVSKNADRTAKRTARKCYDRYQLRRQALINLLKRFGMEPNKNLMLEQTPIKLWQKRADAASKEVSLEELGRVLFHINQKRGYKHSRLSNSDSKETAYVQEVNSRYDDLKAEGLTVGQHFAAKLKENEQESADGKKYYNYRIKEQVYPRHAYEEEVKKILEVQSRYHSDILTPDVCKEIMDIIFYQRDLKSCKNLVSLCEFESYTITKDGKEITIGPKVAPRTSPLAQLSSILETANNITIRNRKNDELYISPEQRKAIADFLDNHEVMKLTDLYKILNIGRKDGWWAGKAIGKGLKGNTTKYQIREALANLPKEKVDSLTAFQLEFDEYVDEETGEVRKRINNTKAEKQPLYKLWHLLYSIKDNKELSGALCHLGIEDEESIEKLGKLDFRTAGYANKSAKAIGRILPYMMEGMMYSDACERAGFDHSKRIDPNRTLLTHLPQIQKNELRQPVVEKILNQLVNIVNALLEKEGTIDEIRVELARELKQSKDERNETFKRNSQNERNNKEYAERIKEYGLTPTRNRIMKMKMWEESEYTCVYCGQPVNVTEFLKGADVEREHIIPRGLLFDNSFTNQVCSCRLCNSKKGMRTAYDFIADDKGQAGLETYIDRINDLFNRKKISRSKFNRLLVSYKAYISRKAKGKETEEDKELWENFIDRQLRQSQYIAKKSVEMLQQVCKNVYTTSGSVTDFVRHQWGYDEILHDLNFERFKKAGLTAMVKQLHSGKEVEVERIMDWTKRLDNRHHAVDALTIACTTQGMIQRLNTLNASRDEMLEELNSKDQRVVDPERSMLEKWIFVQPHISYVEAKNEIDKIVISQRPNTRITVPGKRYVNKNGKRTLVQTDIIVPRGALHAEFVYGRILKQEADGVTMTPQYVRKYKLGIGAQGFLFNGKEFYKEELKKDSKTGLSSIVVTDKIKDVLEKIVDGGIRQRILERLNRGFEEGTDYRANVAKALANLKNLDEDP

SEQ ID NO: 1303 - protein, 1222 aa, Unknown
  Description of Unknown: uncultivated organism with predicted taxonomy: Prevotella sp. ne3005
  MG16-222 effector
MKKVLGLDLGVGSIGWCLLEKDDKNVPIRIIRMGSRIVPISTDEETGFTKGNAISKNADRTAKRTARKCYDRYQLRRQALVNLLRRLGMEPSKNLMLEQPPMELWQKRADAASKEISLVELGRVLLHINQKRGYKHSRLSNSDSKETAYVQEVNSRYDDLKAEGLTVGQHFAAKLKENEQLSADGKKYYNYRIKEQVYPRCAYEEEVKKILEVQSQYHSDVLTADACKEIMDIIFYQRDLKSCKNLVSLCEFESYTITKNGKEITIGPKVAPRTSPLAQLSSILETANNITIRNKRNDELYISPEQRKAIADFLDTHEVLKLTDLYKILNIGRKDGWWAGKAIGKGLKGNTTKCQIRKALSKLPKDLVDSITAFQLEFEEYVDQETGEVRKRINNTLVEKQPLYHLWHLIYSIKDVDELSGALRHLGIEDEESIRNLCDLDFRTAGYANKSAKAIGRILPYLMEGVMYSEACERAGLDHSRRIDPNRTLLKHLPPIQKNELRQPVVEKILNQLVNIVNALLEKEGAIDEVRVELARELKQSKDERNETFKRNNQNERQNKEYAERIKKYSLTPTRNRIMKLKMWEESEHACMYCEEPVDPIEFLKGADVEREHIIPRGLLFDNSFTNQVCSCRRCNSKKGMRTAYDFIADDKGQEGLNAYIDRINDLFDKKKISRSKLNRLLVSHKAYISRKAQGKETEEDKELWENFIDRQLRQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWVFVQPHISYSEAKNEIDKIVISQRPNTRMTVPGKRYVTKNGKRTLAQTGIVVPRGALHAEFVYGRIMKQEPDGITMTPQYVRKYKLGIGAQGFLFNGKEFYKEELKKDSKTGLSKIVVTDKIKEVLDKIVDGGIRQRILERLNRGFEEGADYRANVAQALTNLKNLDEDPIYSDDAKTRPIRTVRKYVSSSTMVAVRKDDKGKPVAFVEPDGNHHVAFYKDENGVISETIVTKWQAVQRKLNHIPIIIDNPSQTWSEVLGRNNVPEELLQSLPKDSSSFLLSLQIGEAFIMGMEEAELQKALEEKDMQKLAEHLYFVQNISSNNYRMRRHVESSFDTTDMNKEDQRFLNISSLDALYRLNPHKVKLTVLGDIVP

SEQ ID NO: 1304 - protein, 1222 aa, Unknown
  Description of Unknown: uncultivated organism with predicted taxonomy: Prevotella copri
  MG16-223 effector
MKKVLGLDLGVGSIGWCLVEKDDKNIPLRIIRMGSRIVPITKEEENGYTRGNAISKNADRTTKRTARKCYDRYQLRRKALVNLLKRCGMMPDKGLILEQSPLDLWQKRADAASKEISLEELGRVLLHINQKRGYKHSRLSNSDKKETAYVQEVNSRYDKLKAEGLTVGQHFAAKLKENEQISADGKKYYNYRIKEQVYPRHAYEEEAKRILEVQSQFHTDVLTTNVCKEIFDIIFYQRDLKSCKNLVSFCEFESYTINKNGKDITIGPKVAPRTSPLAQLSSILETANNITIRNRRNDELYISPEQRQAIANFLDNNEVMKLTDLYKILNIGRKDGWWAGKAIGKGLKGNTTKCQIRKALSKLSQEQIDKLTSFDLIFDEYVDEETGEVRKRINNSHAERQPLYRLWHLVYSIKDNDELSGALRGLGIEDEECIHNLCNLDFRTAGYANKSAKAIGRILPYLMEGMMYSEACNRAGFDHSRRVNPERELLTSLPQIQKNELRQPIVEKILNQLVNVVNALLEKEGTIDEIRVELARELKQSKDERNETYRRNNQNEKKNNEYAERIKEYGLTPTRNRIMKMKMLEESEYKCMYCGQPVREKEFLQGADVEREHIIPKALLFDNSFTNQVCSCRSCNSQKGMRTAYDFIADDKGQEGLEAYIERINDLFNKKKISRSKLNRLLVSHKAYVSRKAQGKETEEDVQLWENFIDRQLRQSQYIAKKSVEILQQVCKNVYTTSGSVTDFVRHQWGYDEILHDLNFEHFKKANLTTMVKQLHSGKEVEVERIKDWTKRLDNRHHAVDALAIACTTQGMIQRLNTLNASRDAMLDELNNKEQRMIDSERSMLEKWIISQPHVSYAEAKKEIDKILISLRPNTRITVPGKRYITKNGKRTLVQTGIIVPRGALHAEFVYGRIMKQEADGVTLTPQYVRKYKLGIGTQGYIFNGNETYKEELKKDKKTGLSQIVVTDKIKDVLEKIVDGGIRKRILERLNRGFEDGTDYRTNTAKALENLKNLDEDPIYSDDAKTRPIRTVRKYVNSSTMVAVRKNDNGKPVSFVEPDDNHHVAFYKDKDGVITESIVTKWQAVQRKLKHIPVIVDNPTQTWNDLVGRNDVSEELLQSLPKDNSEFLLSLQKGEAVILGLEEAAYQKAIDSNDMHTLSNHLYFVQSASLSDYRFRRHVESSFDKMGMNKEDQRFLNVKSIGAFFNYNPHKVKVTILGDIIK

SEQ ID NO: 1305 - protein, 848 aa, Unknown
  Description of Unknown: uncultivated organism with predicted taxonomy: Bacteroides sp. CAG:770
  MG16-224 effector
MKKVLGLDLGVGSIGWCLIEKDDNNVPKRILRIGSRIVPISSDEETGYTKGNAVSKNADRTAKRTARKCYDRYQLRRQALVSLLKRLGMEPNKKLMFEQTPMELWQKRADAASKEVSLEELGRVLLHINQKRGYKHSRLSNSDSKETAYVQEVNSRYDDLKAEGLTVGQHFAAKLKENEQESADGKKYYNYRIKEQVYPRHAYEEEVKKILEIQSQYHSEVLSSDVCKDIMDIIFYQRDLKSCKNLVSLCEFESYTITKDGKEITIGPKVAPRTSPLAQLSSILETANNITIRNRKNDELYISPEQRKAIADFLDNHEVMKLTDLYKILNIGRKDGWWAGKAIGKGLKGNTTKCQIREALSALSKEQIDSLTAFLLEIDEYVDEETGEVRKRINNTLAEQQPLYKLWHMLYSIKDNKELSGALNHLGIEDKESIEKLCKLDFRTAGYANKSAKAIGRILPYLMEGMMYSDACERAGFDHSRRINPERVLLTHLPQIQKNELRQPVVEKILNQLVNIVNALLEKEGAIDEIRVELARELKQSKDERNEAFKRNNQNERQNKELAERIKNYGLTPTRNRIMKLKMWEESEHSCMYCKQPVDPIEFLKGADVEREHIIPRGLLFDNSFTNQVCSCRRCNSQKGMRTAYDFIADDKGQEGLNAYIEHINDLFEKKKISRSKLNRLLVSHKAYLSRKAQGRETEEDKELWENFIDRQLRQSQYIAKKSVEMLQQVCKNVYTTSGSVTDFVRHQWGYDELLHELNIERFKKAGLTAMVKQLHSGKEVEVERIKDWTKRLDNRHHAVDAFAIACTTQGMIQRLNTLNASRDEMFEELNTKDQRLIDPERSMLEKW

SEQ ID NO: 1306 - protein, 1164 aa, Unknown
  Description of Unknown: uncultivated organism with predicted taxonomy: Bacteroidales
  MG16-225 effector
MATKKILGLDLGVGSIGWALIEMEDDKASSILGMGSRIVPLTTDDSTQFSKGQAITKNADRTARRTARKGYDRYQLRRAKLTQVLRQHNMLPERMDEHVIDLWRLRADAATEGKQLTLQQIGRVLYHINQKRGYKHAKADVSADSKQTKYVATVNQRYKDLQNLNQTIGQFFYQQLVDTAVQTPSGPYYTFRIKDKVFPRAAYVAEFDQIMQVQKIFYPEVLTTELINTLRNEIIFYQRPLKSCKHLVGLCEFEMKAYTNKHTGQVVYSGPKCAPRTSPLAQLCAIWEGVNNITLFNKHNEYLDITLEQRKAMVEHLCNNEKMTAKDLQKILGISSKEGWSVEKAIGKGLKGNMTLHQLRKALSKKYSDLLQFDLLMTDHVDEATGEVISRISEAIEQEPLYRLWHVVYSVQEREELGKALHKQFGIDDEAVVEALFKIDFVKPGYANKSHKFIRKLLPYLMKGYKYSEACDHIYVNHSNSMTKEQNATRELVDKIPLLLKNELRQPIIEKILNQMINIVNTLKEQHGNIDEVRVELARELKQSKDERAQTTERINKNERENKAIEERIREHGIRPSRARIQKYKMWEESQHQCFYCGKSISAAEFLSGADVEVEHIIPKSILFDDSFSNKVCACRDCNHTKDNLTARDFMETRGQAELDAYLARVNTAFEEGRISKTKRDHLLWHKEEIPQDFIDRQLRQSQYISKKAVEILRSAIRDVYATSGSVTDFLRHIWGYDQILHNLNLPKYRDAELTEFVTYDHRGQEHQEERIKNWSKRIDHRHHAIDALTIALTRQGYIQRLNNLNASHDDIAEAVRKVNPLMEKKYSLLEKYIYIQPHFTVQEVTDKVDGILVSFRAGKKVTTPAKRAIYRKGKRINVQDGLLVPRGALTEETVYGKLGNKYVVKYPLTHPSMKVDDIVDPTIREIVRARLAAFSGKAKDAFAKPLYSDAAQKMEIKTVRCYTGLQDKAVASVRFNAQGEPIGFAKTGNNHHIAIYQDAKGQYQESVVSFWQAVERKRYGLPIVIEDPKAIWDKLLDSDLPQEFLSTLPQDDWQFVVSLQANEMFILGMEDGDFEMAMQNKDYQLLNKYLYRVQKIRGKEYTFRYHIETTVDDKYSNEKGESKPNPALSMQMKKLISIRSFGGWLAQHPHKVRVNLLGEISEV

SEQ ID NO: 1307 - protein, 811 aa, Unknown
  Description of Unknown: uncultivated organism
  MG16-226 effector
MVPLCYRSATVNGLKKPACILYAPFGDVQDANEMRMVEDAKWNENYWYLKSRHLMWRKHFFIYFYYLTQNFACIYQKKVLPLQRKGFGINTNTYIMTKNILGLDLGVGSIGWALIQTEDDQPKRIIGMGSRIVPLTKDDSDQFTKGQAISKNADRTTRRTTRKGYDRYQLRRALLTQVLRQNGMLPECMDENMIDLWKLRSDAATDGKQLTLQQIGRVLYHINQKRGYKHAKSDNDGDSKQTKYVEEVNLRYKEIQEKNVTVGQHFYAELLNSKVESGNGPYYTFRIKDKVFPRAAYIAEFDQIMRVQKCYYPDVLTDELIETLRNRIIFYQRPLKSCKHLVGLCEFEMRPYKKDGKIVYGGPKCAPRTSPLAQLCAMWETVNNITLTNRNNERLEISNEQRQQLVQFLCTHETLKLTDLYKILGITKKDGWYGGKAIGKGIKGNVTLNQLRKALDGKYSQWLEMPIERIDVVDKNTAEAFWAVSPKVDETPLFQLWHAVYSLQNAEELTKTLQNKFGITDSQVIDALCKIDFVKPGYANKSHKFIRRLLPYLMEGMMYSEACACIQVNHSNSMTKAEREARPLAEKIELLQKNALRQPVIEKILNQMINLVNRLQQEYGSIDEARVELARELKQSRDERKDAFDRNNENEKRNKKISALISEQGIRPSRSRIQKYKMWEESEHRCMYCGKVVNLSEFLNGADVEIEHIIPRSILFDDSFSNKVCACRDCNREKDNMTAMDYMASKPEGEFEAYKQRVDEAFNAHRISKTKRDHLLWRRADIPQAFIDRQLRLSQYIATKAVEILQQGIRQ

SEQ ID NO: 1308 - protein, 854 aa, Unknown
  Description of Unknown: uncultivated organism with predicted taxonomy: Bacteroidales
  MG16-228 effector
MADFLNQHDKMGVKDLQKILGISPKDGWWAGKAIGKGLKGNTTFTQLREALGNLPDAEHLLEMKLHLVDSAVDTTTGELIRQVSPQVEEEPLFRLWHLVYSLQNEDELRKALRKQFGIDDEEILAKLCKIDFVKPGYANKSHKFIRKLLPYLMEGYQYHEACAHIGVNHSDSLTAEQNAARPLLDKIPLLEKNELRQPVIEKILNQMINVVNALKAEYGDIDDVRIELARELKSSKEEREAAFKRNNENERQNKIYEDRIREYGIRPSRSRIQKYKMWEESNHLCFYCGKPVNVTDFLAGAEVEIEHIIPQSVLFDDSYSNKVCACRTCNHTKGNQTAREFMETHSKAEYESYLLRVDDAFNAHRISKTKRDHLLWRKEDIPQDFIDRQLRQSQYIAKKAAEILRQGYRNVYATSGSVTDFLRHQWGYDEILHRLNLPRYQQVEGLTELVTYDHCGQEHQQERIKGWTKRLDHRHHAIDALTIALTQQSVIQRLNTLNTSREQMFDDLGKRTDTPEYTEKRSLLENWIDAQPHFSVQEVTDKVDGILVSFRAGKRAATPAKRAVYQNGKRHIVQTGLQVPRGALSEETVYGKLGNKYVVKYPLGHQSMKVDDIVDPTIREIVRTRLNAFGGKAKDAFAEPLYSDAAHQMQIKTVRCYMGLQDKAVVPVRFNAKGEPVGFVKMGNNHHIAIYRDANGQFQESVVSFWQAVERKRYGIPVVIEHPHEVWDKLINIDNIPQEFLETLPRDDWQFVVSLQQNEMFILGMDDADFEAAMEQKDYRTLNKYLYRVQKIATKNYYFRYHTETSVDDKYDGEKNEMWSKNMKKLINIRSFDAFFSQHPHKVRINLLGEVSAL

SEQ ID NO: 1309 - protein, 887 aa, Unknown
  Description of Unknown: uncultivated organism with predicted taxonomy: Bacteroidales
  MG16-229 effector
LAQLCTVWEAVNNITLTNRQNETFEITQEQRVAMADFLNQHDKMGVKDLQKILGISPKDGWWAGKAIGKGLKGNTTFTQLREALGNLPDAEHLLEMKLHLVDSAVDTTTGELIRQVSPQVEEEPLFRLWHLVYSLQNEDELRKALRKQFGIDDEEILAKLCKIDFVKPGYANKSHKFIRKLLPYLMEGYQYHEACAHIGVNHSDSLTAEQNAARPLLDKIPLLEKNELRQPVIEKILNQMINVVNALKAEYGDIDDVRIELARELKSSKDEREAAFKRNNENERQNKIYEDRIREYGIRPSRSRIQKYKMWEESNHLCFYCGKPVNVTDFLAGAEVEIEHIIPQSVLFDDSYSNKVCACRTCNHTKGNQTAREFMETHSKAEYESYLLRVDDAFNAHRISKTKRDHLLWRKEDIPQDFIDRQLRQSQYIAKKAAEILRQGYRNVYATSGSVTDFLRHQWGYDEILHRLNLPRYQQVEGLTELVTYDHCGQEHQQERIKGWTKRLDHRHHAIDALTIALTQQSVIQRLNTLNTSREQMFDDLGKRTDTPEYTEKRSLLENWIDAQPHFSVQEVTDKVDGILVSFRAGKRAATPAKRAVYQNGKRHIVQTGLQVPRGALSEETVYGKLGNKYVVKYPLGHQSMKVDDIVDPTIREIVRTRLNAFGGKAKDAFAEPLYSDAAHQMQIKTVRCYMGLQDKAVVPVRFNAKGEPVGFVKMGNNHHIAIYRDANGQFQESVVSFWQAVERKRYGIPVVIEHPHEVWDKLINIDNIPQEFLETLPRDDWQFVVSLQQNEMFILGMDDADFEAAMEQKDYRTLNKYLYRVQKIATKNYYFRYHTETSVDDKYDGEKNEMWSKNMKKLINIRSFDAFFSQHPHKVRINLLGEVSAL

SEQ ID NO: 1310 - protein, 1175 aa, Unknown
  Description of Unknown: uncultivated organism with predicted taxonomy: Bacteroides sp. CAG:545
  MG16-230 effector
EFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFVLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEASDNVSRILVSFKAGKKVTTPGKRYVYRGGKRVLAQEGLLIPRGALCEESVYGRIHSLEKEVPVKKLFERVDDIVKPGIRTTVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGIPAPDWKFVMSMQQNEMFVLGMEDDEFRDAMEVKDYKTLGAHLYRVQKLTSIYYVFRHQYETQLDDSKGAQIMKKFYRAQSFKALFSLHPRKVSVSLLGEMALKDD

SEQ ID NO: 1311 - protein, 890 aa, Unknown
  Description of Unknown: uncultivated organism with predicted taxonomy: Bacteroides sp. CAG:770
  MG16-231 effector
MKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKAGRESAAKNIRTREKANEEIAKRIEELGLVPSKNKILKYRLWEESGKRCFYCGQPVSAAEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNILNAKTAIGEEQMSLDKWTLAQAHFSVADVADHVADILVSFKSGKRVTTPGKRYVYKAGRRIVAQENILVPRGALSEESVYGRIKSIEEKVPVKKLFERADDIVKPRIRHLIRERLATCGGDCSKAVSSLKKSPLYLDEENTIMLEYGSCFKPEYVIKYSLNSIKAKDAVSIVDNHVREVVTERLAAFGDDPKKAFAEPLYADETGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDAMAGMDYKSLGEHLYRVQKLASLYYVFRSQYETKLDDSNNALAMRKFYRIRSFNALFSLNPRKVSISLLGEISLKDD

SEQ ID NO: 1312 - protein, 1133 aa, Unknown
  Description of Unknown: uncultivated organism with predicted taxonomy: Bacteroides sp. CAG:770
  MG16-232 effector
MLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFVLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLSQPHFSVQEVSDNVSRILVSFKAGKKVTTPGKRYVYRGGKRVLAQEGLLIPRGALCEESVYGRIHSLEKEVPVKKLFERIDDIVKPGIRAAVEERLRACDNDVKVACASLKKEPLYLDVEKTIPLEYGTCYKAKYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLASIDYYFRSQYETALDNSAGARMMKKFYRINSIKSLFALHPRKVSVSLLGEMALKDD

SEQ ID NO: 1313 - protein, 1010 aa, Unknown
  Description of Unknown: uncultivated organism with predicted taxonomy: Bacteroides sp. CAG:545
  MG16-233 effector
MDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHALDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1314 - protein, 1121 aa, Unknown
  Description of Unknown: uncultivated organism with predicted taxonomy: Bacteroides sp. CAG:770
  MG16-234 effector
MDLWTLRARAATPGEKLSLAEIGRVLYHLNQKRGYRHSKEDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIEEVLRFDLSAVESNQVNADTGEVLMEISAECGREPLYRLWHIIYSISDKNEQKSALKSQFGILDESMLESLCRIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIAKRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKRVTTPGKRYVYKAGRRRVVQENILVPRGALSEESVYGRIKSIEEKVPVKKLFERVDDIVKPRIRRLIRERLEACGGDCSKAVSSLKKSPLYLDEEKTIMLEYGSCFKYSYVKKSKLIQRDKKDDFINVSLIVDKHIREVVTARLAAFGGDTKKAFAEPLYADEAGKIQIRTVRCYTNSTVVPVKKDADGNDIGFVKPGNNHHIAIYKDADGTYYWKLVTLWNAVDRKRYGLPIIVRNPYEISDIIIDSNIPDALASGLPEPNWSFVMSLQQNEMFVLGMSEEEFRCAIENKDYKTLGMHLYRVQKLSHLRFRSQYETRLDDSSEAKNMKKFYEIRSLKSFWSLNPRKVSISLLGEISLKDD

SEQ ID NO: 1315 - protein, 1121 aa, Unknown; identical to SEQ ID NO: 1314
  Description of Unknown: uncultivated organism with predicted taxonomy: Bacteroides sp. CAG:770
  MG16-235 effector

SEQ ID NO: 1316 - protein, 1045 aa, Unknown
  Description of Unknown: uncultivated organism with predicted taxonomy: Bacteroides sp. CAG:770
  MG16-236 effector
KLKESEIITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDAVGINHSDSITKAKNQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTASLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKKVATPGKRYVYKAGRRRVVQENILVPRGALSEESVYGRIKSIEEKIPVKKLFERADDIVKPRIRRLIRERLEACGGDCSKAVSSLKKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISLLGEISLKDD

SEQ ID NO: 1317 - protein, 956 aa, Unknown
  Description of Unknown: uncultivated organism with predicted taxonomy: Bacteroides sp. CAG:770
  MG16-237 effector
PILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGEHLYRVQKLTSLYYVFRHQYETQLDDSKGAQIMKKFYRVRSFNAMFALHPRKVSVSLLGEMALKDD

SEQ ID NO: 1318 - protein, 970 aa, Unknown
  Description of Unknown: uncultivated organism with predicted taxonomy: Bacteroides sp. CAG:545
  MG16-238 effector
MRIYDKEFPGRRSQTNIEQFRRTRNAGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYALSALKPKDVEFIVDEHIRKVVSERLSEYGNDPKKAFAEPLYADKSKMIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLTSIDYYFRSQYETTLDDSAGARMMKKFYRITSIKSLFALHPRKVSVSLLGEMALKDD

SEQ ID NO: 1319 - protein, 788 aa, Unknown
  Description of Unknown: uncultivated organism with predicted taxonomy: Bacteroides sp. CAG:770
  MG16-239 effector
LTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKACDNDVKAACTSLKEEPLYLDAEKTIPLEYGTCYKREYVIKYPISSLKTKDVESIIDGHIRQIVSERLSEYGNDPKKAFAEPLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRVRSFNALFNLHPRKVAVSLLGEMSLKND

SEQ ID NO: 1320 - protein, 1182 aa, Unknown
  Description of Unknown: uncultivated organism with predicted taxonomy: Bacteroides sp. CAG:709
  MG16-240 effector
LSPDESSEFTSGNAASKNQKRTQKRTARKGYDRYQMRRQALTDKLRKLKMLPDEHLIKLPILDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDKVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDKLKACDNDVNAACASLKKEPLYLDAEKTIPLEYGTCYKRKYVIKYPISSLKAKDVESIIDGHIRQIVSERLSEYGNDPKKAFAEPLYADDAKTIPVRTVRCYTGLDQVVPVKKDVAGNDIGFVKPGNNHHIAIYRDADGKFHECVVTFWDAVERKKWGIPVIVRNPDEVWDVVIDKNVPEELAAGLPALGWSFVMSLQQNEMFVLGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1321 - protein, 1180 aa, Unknown
  Description of Unknown: uncultivated organism with predicted taxonomy: Bacteroides sp. CAG:770
  MG16-242 effector
PDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKIINQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKKDVAGNDIGFVKPGNNHHIAIYRDADGKFHECVVTFWDAVERKKYGMPVIVRNPDEVWDDVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1322 - protein, 1221 aa, Unknown
  Description of Unknown: uncultivated organism with predicted taxonomy: Bacteroides sp. CAG:709
  MG16-243 effector
MKKNLGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGISKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKTLLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGERYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAETIPVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1323 - protein, 1159 aa, Unknown
  Description of Unknown: uncultivated organism with predicted taxonomy: Bacteroidales
  MG16-245 effector
MKKKVLGLDLGVGSIGWALIETTDNQPEEIVGMGCRIVPIGKDDSDQFSKGQAISKNADRTARRTARKGYDRYQLRRALLTQVLRQNGMLPERMDENVIDLWKLRSDAATEGEKLTLPQIGRVLYHINQKRGYKHAKADDSADKKQTDYVAAVNQRYADLQAENKTIGQHFYLELLRSKVEGASGPYYTFRIKDKVFPRAAYIEEFDQIMHVQRTYYPTILTNELIDTLRNRIIFYQRPLKSCKHLVSLCEFEMRPYKTKDGRIVYGGPKCAPRTSPLAQLCAMWETVNNITLTNRDNEKLDITLEQRKQMVEFLCANKELKLTNLYKILGISKKDGWYGGKAIGKGLKGNATLLQLREALGGKYDQWLEMPVELKDSKWVDTETGEVIKEVAETIEQTPLFRLWHAVYSLQNADELAKTLREKFEITDKAVIDALCKIDFVKPGYANKSHKFIRRLLPYLMNGYQFSEACAHIGINHSNSMTAEERDSRTLVERIELLPKNALRQPVIEKILNQMINLVNRLQQEYGPIDEARIELARELKQSREERDNAYKAINKNERENAAIAAKIAEFGIRPSRSRIQKYKMWEESNHRCFYCGKTMDIAQFLNGADVEIEHIIPRSILFDDSYSNKVCACRDCNREKDNATAMEYMAGKPTGEFEAYKQRVDEAFTEHRISKTKRDHLLWRRADIPQDFIERQLRQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSILERWVADQPHFSVADVTNKVDGILVSFRAGKRVTTPARRAIYSGGKRKIVQTGLQVPRGALTEDTIYGKREEGFVVKYPLDHPSMKVENILDPTIQNLVKEHIAAFGGNAKEAFKMPLFSAKGMQIKSVRCKTNLSENSVVPVKVNADGQPIGYAKKGNNHHVAIYQDKKGEYQELVVSFWDAVERKHYGVPVVIINPHEVWTDLVNKDLSQDFLNKLPHDDWQFVLSMQENEMFVLGLEDDEFNDAIERQDYNLLNKHLYRVQKISSKDYSFRYHTETKVDDKYDGIENGRSTSMSLGALFRFKSINGLFSQFPHKVKIDIMGRITKA

SEQ ID NO: 1324 - protein, 972 aa, Unknown
  Description of Unknown: uncultivated organism with predicted taxonomy: Bacteroides sp. CAG:770
  MG16-246 effector
SYTIKKDGKEITIGPKVAPRTSPLAQLSSFLETANNITIRNKRNDELYISPEQRKAIADFLDNNEVMKLTDLYKILNIGRKDGWWAGKAIGKGLKGNTTKCQIRKALSNFPKDQINSLTAFQLEFDEYVDEETGEVLKRVNNTQAEKQPLYRLWHLLYSIKDVDELSGALRHLGIEDEESITKLCNLDFRTAGYANKSAKAIGRILPYLMEGMMYSDACERAGFDHSRRINPDRDLLKSLPQIQKNELRQPVVEKILNQLVNIVNALLEKEGIIDEIRVELARELKQSKDERNEAFKRNNQNERQNKEYAERIKEYGLTPTRNRIMKMKMWEESEYTCMYCGQPVNVTEFLQGADVEREHIIPRALLFDNSFTNQVCSCRRCNSQKGMRTAYDFIEDDKGQEGLNAYIERINDLFNRKKISRSKFNRLLVSHKAYISRKAQGKETEENKELWENFIDRQLRQSQYIARKSVEMLQQVCKDVYTTSGSVTDFVRHQWGYDEILHDLNFERFKKAGLTTMVTQLHSGKEVEVERIKDWTKRLDNRHHAVDALAIACTTQGMIQRLNTLNASREGILDELNSKEERVVDPERSMLEKWIYTQPHISYAQAKEAIDNIIISQRPNIRITVPGKRYITKNGKRTLAQTGIIVPRGALHAEFVYGRIMKQGADGVTLTPQYVRKYKLGIGAQGFLFNGKEFYKEELKKDSKTDLSSIIVTDKIKDVLEKVVDGGIRQRILERLNRGFEEGTDYRANVAQALANLKNLDEDPIFSDDAKTRPIRTVRKYVSSSTMVAVRKDCNGKPIAFVEPDGNHHVAIYKDENGMITESIVTKWQAVQRKLNHIPVIIDNPSQTWSEIMGKNDVPEELLQTLPKDKSTLLLSLQIGEAFIMGMDDAEYQKAVEEKDMQALAEHLYFVQSISSSDYRFRRHIESQYDTNDINKEDLRFLRIRKIQALFEYNPQKVKVTVLGDIILLNT

SEQ ID NO: 1325 - protein, 1162 aa, Unknown
  Description of Unknown: uncultivated organism with predicted taxonomy: Porphyromonas sp. oral taxon 278
  MG16-247 effector
MKKRILGLDLGVGSIGWALIETTDNKPEQIVGMGCRIVPISKDDNDQFSKGQAISKNADRTARRTARKGYDRYQLRRALLTQVLRQNGMLPDRMDENAIDLWKLRSDAATEGEQLTLPQIGRVLYHINQKRGYKHAKSDDNGDKKQTDYVAAVNQRYVDLQAEDKTIGQHFYLELLNSRVEGVNGPYYTFRIKDKVFPRAAYIAEFDQIMRVQQPFYPDVLTDELIDTLRNRIIFYQRPLKSCKHLVSLCEFEMRPYKTKDGRIVYGGPKCAPRTSPLAQLCAMWETVNNITLTNRNNEKLDITLDQRKQMVDFLCSNKELKLTNLYKILGISKKDGWYGGKAIGKGIKGNATLLQLREALGGKYDQWLEMPIELKDSKWVDAETGEVMKEVTEAVEQTPQFRLWHAVYSLQNVDELAKTLRTTFQITDEAVIEALCKIDFVKPGYANKSHKFIRRLLPYLMDGYQYSEACAHIGINHSNSMTAEERDERPLAERIELLPKNALRQPVIEKILNQMINLVNRLQQEYGPIDEARVELARELKQSRDERDSAYKAINKNERENAAIAAKIAEFGIRSSRSRIQKYKMWEESSHRCFYCGKTMDITQFLSGADVEIEHIIPRSILFDDSFSNKVCACRECNREKGNMTAMEYMEHKPAGEFEAYKQRVDEAFTDHRISKTKRDHLLWRRADIPQDFIDRQLRQSQYIAVKAVEILQTGVRRVWTSGGSVTDFLRHQWGYDEILHTLNLPRYRQVEALTEIVHYEHAGQEHNEERIKNWTKRTDHRHHAIDALTVALTQQSYIQRLNTLEASHDWMEKQVKEANTPYNEKKSVLERWVADQPHFSVAEVTDKVDGILVSFRAGKRVTTPARRAVYRGGKRTIVQTGLLVPRGALTEDTIYGKCEDGFVVKYPLDHPTMKPENIVDPTIRRLVEKRIAAYGGNTKEAFKTPLYSAEGMEIKSVRCLTNLSEKGVVPVKYDKTGQPIGFAKKGNNHHVAIYKSDNDKPFDQVVSFWDAVERKRYSVPIVIDNPHEVWDGLLNRDMPQEFLDKLPHDDWQFVLSMQENEMFVLGLEDDEFNDAIERQDYNSLNKHLYRVQKITHNDYWFRFHTETTVDDKYGDQENQVVNVAWSTEMKKVFRFKSQGALFAQFPHKVKIDIMGRITKA

SEQ ID NO: 1326 - protein, 863 aa, Unknown
  Description of Unknown: uncultivated organism with predicted taxonomy: Coprobacter sp.
  MG16-248 effector
KLDITLEQRKQMVEFLCTNKELKLTNLYKILGISKKDGWYGGKAIGKGLKGNATLLQLREALGGKYDKWLEMPVELKDSKWVDTETGEVIKEVAETVEQTPLFKLWHAVYSLQNEDELAKTLREKFQITDAIVIDALCKIDFVKPGYANKSHKFIRRLLPYLMAGYQYSEACAHIGINHSNSMTKEEREARPLTEQIELLHKNALRQPVIEKVLNQMINLVNRLQQEYGPIDEARVELARELKQSREERDSAYKAINKNERDNAAIAAKIAEFGVRPSRSRIQKYKMWEESNHRCFYCGKIMDITQFLNGADVEIEHIIPRSILFDDSYSNKVCACRDCNHEKDNSTAMEYMESKPAGEFEAYKQRVDEAFSAHRISKTKRDHLLWRRGDIPQDFIERQLRQSQYIAVKAVEILQAGIRHVWTSGGSVTDFLRHQWGYDEILHTLNLPRYRKVDELTEIVHFEHAGQEHEEERIKNWTKRIDHRHHAIDALTVALTQQSYIQRLNTLEASHDWMEKQVKEVNTPYNEKKSVLERWIADQPHFSVSDVTDKVDGILVSFRAGKRVTTPARRAIYPGGKRTIVQTGLQVPRGALTEDTIYGKREEGFAVKYPLDHPSMKAENILDPTIRRLVEERIAAFGGNAKEAFKTPLYSAKGMEIKSVRCKTNLSENGVVPVKRNALGQPIGFAKKGNNHHVAIYKTGNEKPFDQVVSFWDAVERKRYGVSVVIDNPREMWNGLLNKELPQDFLNKLPHDDWQFVLSMQENEMFVLGMENDEFNDAIERHDYNTLNKHLYRVQKIAHNDYWFRFHIETSVDDKYGDKEKQVLNMAWSTELKKVYRFNSQGALFAQFPHKVKIDIIGRITKV

SEQ ID NO: 1327 - protein, 970 aa, Unknown
  Description of Unknown: uncultivated organism with predicted taxonomy: Bacteroides sp. CAG:144
  MG16-249 effector
ISQCEFAMREYTTADGKRIQAGPKVAPRSSPLFQVCKIWESVNNIEMKNRNGESYPFSEEERLKLFNFLDNNEKLTVTDLKRILGLSVKDKWWGGKAIGKGLQGNTTKIALKKALQGHEGLLSFHLKTVDSRHIDTETGVILQEIAPGFEKEPLYRLWHIIYSIKEPDEMASALKQQFGIEDPEVLSRLAKIDFVKAGYGNKSARFIRQILPYLQKGLKYSEACDYISINHSNSLTTAENKSRKLQPRMQQLQKNELRQPIIEKILNQMVNVVNALLDKHVSIDEVRVELARELKQSRDERNSTFLNNSKRERENKIISERIQEMGIRPSRNRIQKYRLWEESKHICFYCGQPVGVREFMEGVDVEIEHIIPRSLFFDDSFSNKVCACRKCNAEKGNRTAYDYVKKKGENEFADYTRRIEEAFEKKEISKTKRERLLTSAKDIPEDFIDRQLRQSQYISKKAVEMLKQVCRNVWTTSGSVTDFVRHQWGYDNILHDLNFKRYKDAGQTEIIVCDQMGQVRQVERIKDWTKRLDHRHHAIDALTIASTKQSYIQRLNHLNASRDQMFQELETQSNKVREEYSLLENWMKERPHIPVSVVSQIVDGILVSFKTGKRLTTPGKRYTYKGGKREIAQSGIIVPRGALSEDSVYGVISCLEENVPVKKLFEHPDIIFKPYIRTKVENRIKEYDGDWKAALKSLKKAPIFLGDGETKPLEYATCWKKEYVIRYPLASIQKKDVKYIVDQHIRQLVSERLNAVGEKDAFKEPLFSDKAEKNPIKSVRLFTGLTHNSLSPVKYLDGFPIGYSKPGNNHHFCYYRNENGELFEHIVSFWHAVDRKKYGIPVIIEDTDVLWDEMANRDLPQDFLKYLPPVGLKLEVSLQQNEMFILGMKDEDYERSIKEKDLRMLNQYLYRVQKISSQYIVFRRNTDTGKDEDSKAQSIGQFVRVSSIKGWIQCNPHKIRVNVLGEISEI

SEQ ID NO: 1328 - protein, 758 aa, Unknown
  Description of Unknown: uncultivated organism with predicted taxonomy: Sediminibacterium sp. C3
  MG16-250 effector
MYSEACERAGFDHSRRIDPNRTLLTHLPQIQKNELRQPVVEKILNQLVNIINALIEKEGAIDEIRVELARELKQSKDERNETFKRNNQNERQNKEYAERIKEYGLTPTRNRIIKMKMWEESEYTCMYCGQPVNVTEFLKGADVEREHIIPRGLLFDNSFTNQVCSCRRCNSKKGMRTAYDFIADDKGQEGLNAYIDRINNLFDKKKISRSKLNRLLVSHKAYISRKAQGKETEEDKELWENFIDRQLRQSQYIAKKSVEMLQQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDVMLEELSSNDQRLVDPERSMLEKWIYVQPHISYAEAKNEVDKIVISQRPNTRITVPGKRYVTKNGKRTLAQTGIIVPRGALHAEFVYGRIMKQEADGFTMTPQYVRKYKLGIGAQGFLFNGKEFYKEELKKDSKTGLSSIVVTDKIKDVLDKIVDGGIRKRILERLNRGFVGGADYRANIAQALANLKNLDEDPIYSDDAKTRPIRTVRKYVSSSTMVAVRKDSNGKPMSFIEPDGNHHVAFYKDENGVIKESIVTKWQAVQRKLNHIPIIIDNPSQTWSEVLGRNDVPEELLQSLPKDSSTFLLSLQIGEAFIMGMEDSDYQKALEERDMRTLSEHLYFVQNISSNNYRLRRHVESSFDITDMNKEDQRFLNIKSVNSFFNNNPHKVKITILGDIIADL

SEQ ID NO: 1329 - protein, 808 aa, Unknown
  Description of Unknown: uncultivated organism with predicted taxonomy: Bacteroides sp. CAG:144
  MG16-251 effector
NALNDLDFVTPGYANLSAKAISKILPYMMEGLDYSDSCEYVGYNHSDSLTKEENEKRELLDKIPALKKNELRQPTVEKILNQTINVFNEINANFISKGERVDEVRVELARELKQSKEEREETERGIRKQQKANDGYAKLLKEGGVRPTRNRILKYRLWRESNETCFYCGQPINFNEFLKFSDVEREHVIPKKLLFDDSFANQVCSCRKCNAEKGGRTAFDYMRTKQNLQDYLDKVDKMFQEHKIGGKKHSHLLASYDDYLSRKKEGKETKDDVKIWEEPIERQLRLSQYISKKSQELLKMACRNVVATSGNITDLVRHTWGYDTILHELNFPCYKEAGLTTFIKDENTGQQREVIKDWTKRLDHRHHAIDALAVACTSRSIVQRINTLHASREEMREDVKSPRKDWEDNDLLQQWIKEKMPFDRDYVLHKVASILVSMKAGKKATVPGKRKIYKNGKPITVQSRLRIPRGQLHEQTVYGAIKQYSKDKKGNVIESREIVTRYKMGVGSVGLVFNGKETCDVIYNKKKECYEIIDGIEKSINYIVDKHIREVVRERINEAFPNGETYRSEAENALAEGRVYNGKERCQKALEQLKSLDEHPLYADKNHHIVIKSVRCFTGLGAVQPLRYNNDNEPISFVLTKNNHHVAIYADENGDYKECIYTFWQVVERSKYKLPLIIKDPKALWEEIRQRENNGERFPDTLIASLPSPNWAFVESLQLNDMFVLDIDDEDFENFIANDNYEEIGKKLYRIQNISSGDYFLRLHTDTTSDRSNSKLTKKFLRKSLMGFLNSNPHKVSISILGKMKIVK

SEQ ID NO: 1330 - protein, 936 aa, Unknown
  Description of Unknown: uncultivated organism with predicted taxonomy: Bacteroidales
  MG16-252 effector
QVCKIWESVNNLSLKNRSGEVYHFSQEERRKMFDFLDNHDKMTVTDLYKLLGISKKEGWWGGKAIGKGLQGNTTKAALAKALGERQDLLQFQLETIDSRQIDTETGEVLKTISPSFEKEPLYRLWHILYSMHERSEVAAALERQFGITAPDTVDRLFAIDFVKAGYGNKSARFIREILPYLQAGMQYSQACDYIGINHSNSLTIEENASRVLLDRLPQLQKNELRQPVIEKILNQMVAVVNALLSQYGPIDEIRVELARELKQSRDERNDAYLSINKRERENKVIEERIREYGISPSKSRIQKYRLWEESNHLCFYCGHPVGAAEFLSGSGVEIEHIIPRSLLFDDSFANKVCACRKCNAEKGNSTAFDYMKSKPANDFEDYLKRVEKYFTEKRISKTKRERLLTPASEIPQDFIDRQLRQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKKVATPGKRYTYKNGKKELVQDGLLIPRGALSEESVYGQITTIEPSVPVKKLFEDPSLIFKPYIRELVERRIKECGGDWKKARASIGKKPIWLDTEETVALEFATCWKKEYVMKYPVSSLKAKDVDSIVDRHIREIVRRRIDEVGEKEAFKTPIYTDDAQSIPLRSVRLFTGLDAVEPVKYVDGVPVGFSKPGNNHHIAIYRDKDGNRSEHVVSFWHAVERKRYGLPVIIRDTDSVWDQIEGESLPESFLKNLPQPGLKLELSLQQNEMLILGMKEDEFNDAIREKDTRRLNKHLYRVQKLSTMYYVFRYHTETQIDDSKGALEMHKFYRTVSFRALDALFPHKVRISVTGELIPIQ

SEQ ID NO: 1331 - protein, 851 aa, Unknown
  Description of Unknown: uncultivated organism
  MG16-253 effector
KLKDVHEVLGINSKSGWYCDKAIKSGIKGNSTKCAIISALSSLPNSIIREITRFNLETETSNMVDEETGELLVRIKSTYQEEPLYRLWHIIYSIKNDAERLNTILVFLKEFGIEDVSIANALNDIDFVTPGYSNLSAKAISKILPYMMEGLDYSESCEYVGYNHSDSLTKEENEKRELLDQIPAIKKNELRQPTVEKILNQTINVFNQINADLGKKGERVDEVRVELARELKQSKEEREETDKGIRKQQKANEEYADILKKKGVRPTRNRILKYRLWKESEEACFYCGRDIDFHEFLRFSDVEREHVIPKKLLFDDSFANQVCSCRRCNAEKGGRTALDYMRTKPNLQEYLDKVDKLFQEHKIGGKKHAHLLASYDDYLSRKKEGKETKDDIMIWEEPIDRQLRLSQYISKKAQELLKAACREVMATSGSITDLIRHTWGYDTILHELNFPRYKDAGLTEIIKDEETGMQREVIPDWSKRLDHRHHAIDALAVACTSRSIVQRINTLNASREIIREEIKTSRKEWEDNDLLQQWIKEKMPFDRQYVVQKVASILVSMKAGKKATVPGKRKIYKNGKPVIMQTGLRIPRGQLHEQTVYGAIKHHSKDKKGNVIETKEIVTRYKMGAGSVGFVFTGKETCDVVFDKKNERYVIVDGIGKAINYIVDRHIREIVRERINEAFPDGETYLSEAEKALAEGRLYNSKDRCQKALEQLKSLDEHPLYADKNKTIVIKSVRCFTGLNAVQPLRYNSKHEPISFVLTKNNHHVAIYVDEKGEYQECVYTFWQVVERAKYRLPLIIQDPKTIWDEIRQREKDGDSFPDDLITSLPLPNWTFVESLQQNDMFVMDMDDDTF

SEQ ID NO: 1332 - protein, 919 aa, Unknown
  Description of Unknown: uncultivated organism with predicted taxonomy: Marinilabiliaceae
  MG16-254 effector
NRIIFYQRPLKSCKHLVSLCEFEARPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKHIDVVDATTSEVFWAVSPEVEETPLFKLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAEKISEFGIRPSRSRIQKYKMWEESLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKTDIPADFIERQLRQSQYIAVKAVEVLQDGIRQVWTSGGSVTDFLRHQWGYDEILHTLNLPRYRQVEGLTELVDFEHAGQKHTEERIKNWSKRIDHRHHAIDALTVALTQQGYIQRLNTLEASHDFMEKQVKEAGTKYNEKKSILEKWINEQPHFSVEEVTNAVDRILVSFRAGKRVTTPARRAIYKGSKKTIVQTGLQVPRGALTNDFVYTKHGKKYARKYPINAISNPENIVDATIRQLVKARLASHGGNINDAFKTPLYSAEGMEIKTVRCYNNKLSDRGVVAIKYNEQKEPIGFAETDNNHHMAIYKLADGSLKERVVSFWDAVERKRYGLPIIITNPNEVWSIVLEKDLPQDFLNKLPEDKWEYVLSLQENEMFVLGMEDDEFNDAIDTHDYNLLNKHLYRVQSISYGDYYFCHHTETKATDKNESIKLGKTLRIRGVNSLKSYFPHKVQVDLLGHIHKV

SEQ ID NO: 1333 - protein, 1221 aa, Unknown
  Description of Unknown: uncultivated organism with predicted taxonomy: Bacteroidetes
  MG16-255 effector
MKRVLGLDLGVGSVGWALVEKDERNIPINVNKIGSRTVPLSNDEENNFSKGAAIPTNKDRTIKRTARKCNNRYKLRREQLTNGLRALKMLPDETLFKLDPLQLWELRAKAATEKVSLPELGRVLYHLNQKRGYKHSKDNEQDSKQTDYVATVNKRYKDLQSKNLTIGQYFAQKLKESEHIQEGGKSYSFRIKDNVYPRAAYEEECKRILSTQKQFYPDILTDNNVKDLFQFIYYQRPLRSCKHLISRCSLEEQLHDVKEKDFYAPKVAPISSPLAQLDKIWEAVNNFTVRGKRNEELYITHEQRSAIVEHLEHNKDIKLTAIQKILGIGKSKEWFIKKEQLKPLQGDITRIKLAEALSSGHLSKEKIENLLLLKIDFEEMADTTTGEVMGGIVVKNNIESQPLYQLWHAIYSIDDEKALRKTLAKLGIDDDDVMDALCKISFKTSGYAKKSTRAIKKILPYLMEGYQYSDACQMAGYNHSNSITKEEEASRPLQDHIPQIQKNELRQPVVEKILNQMINIVNTLLKDGPIDEIRVELARELKRSKDEREMANIRMNRNKRRNDEIASIIQNEYGLIPTKNRIMKYKMWEETDGFCIYCGTKIKLAEFLGGVDSEREHIIPKSLLFDDSFSNQSCACRKCNKEKGNRTALDYMRDIGKEKQYVEHIAELLEKDKISKTKYSNLLASYKDYLERKAKGKETEEDKNLWENFIDRQLRLSQNIARSAMELLRQVCHNVYATSGSVTDFVRHQWGYDNILHDLNFSRFAKSGNTEFITVVGADGKETQQERIKGWSKRMDNRHHAVDALAIALTTQSMIQRINNLNASREFMQKDVEASKEKFKEKKSLLEKWVAIQPHLSYGQAKDAISGILVSQRSGKHITTPGKRYEYKGGSKILRQQGLVVPRTALHDEFVYGRISRYDKNGILQPEIVRKYGILGGMGCLFDGKETYKETEKTDKKIGLPKIKIEDKIKDVLDKIVDGGVRKRILERLNRGFEEGKDYRNDTKKALDNLRNLDEDPIYLDDAHTIPIKTVRKFTHSTKAIPLRYNDKNEPIAFVEPGGNHHVALYETADGTVKEHVCTNWHAVQRRMYGFPAIIDNPSDAWQQASNNDKLPEDLLMHLPDDNSKFLLSMQIGDAFILGMEEYEYQAAINEKNYKLLGEYLYFVQKLSSNDYAFRRHVESKYEEKQTNKDDGRFIRIRSIDKYENYNPHKVKITLLGEIFP

SEQ ID NO: 1334 - protein, 829 aa, Unknown
  Description of Unknown: uncultivated organism with predicted taxonomy: Bacteroides sp. CAG:144
  MG16-256 effector
ERLHSIIRFLKDFDVEDILIANALNDLDFVTPGYANLSAKAISKILPYMMEGLGYSDSCEYVGYNHSDSLTKDENEKRELLDKIPALKKNELRQPTVEKILNQTINVFNEINANLISKGERVDEVRVELARELKQSKEEREETERGIRKQQKANDEYAKLLKEGGVRPTRNRILKYRLWRESNETCFYCGQPINFNEFLKFSDVEREHVIPKKLLFDDSFANQVCSCRKCNAEKGGRTAFDYMRTKQNLQDYLDKVDKMFQEHKIGGKKHSHLLASYDDYLSRKKEGKETKDDVKIWEEPIERQLRLSQYISKKSQELLKMACRNVVATSGNITDLVRHTWGYDTILHELNFPCYKEAGLTTFIKDENTGQQREVIKDWTKRLDHRHHAIDALAVACTSRSIVQRINTLHASREEMREDVKSPRKDWEDNDLLQQWIKEKMPFDRDYVLHKVASILVSMKAGKKATVPGKRKIYKNGKPITVQSRLRIPRGQLHEQTVYGAIKQYSKDKKGNVIESREIVTRYKMGVGSVGLVFNGKETCDVIYNKKKECYEIVDGIEKSINYIVDKHIREVVRERINEAFPNGETYRSEAENAFAEGRVYNGKERCQKALEQLKSLDEHPLYADKNHHIVIKSVRCFTGLGAVQPLRYNNDNEPISFVLTKNNHHVAIYADENGDYKECIYTFWQVVERSKYKLPLIIKDPKALWEEIRQRENNGERFPDTLIASLPSPNWAFVESLQLNDMFVLDIDDEDFENFIANENYEEIGKKLYRIQNISSGDYFLRLHTDTTSDRSNSKLTKKFLRKSLMGFLNSNPHKVSISILGKMKIVK

SEQ ID NO: 1335 - protein, 1159 aa, Unknown
  Description of Unknown: uncultivated organism with predicted taxonomy: Bacteroidia
  MG16-257 effector
MIKHILGLDLGVGSIGWALIETENDQPKQIIGIGSRIVPLSKDDSDQFSKGQAISKNADRTARRTTRKGYDRYQLRRALLTQVLRQNGMLPERMDENVIDLWKLRSDAATEGHQLTLPQIGRVLYHINQKRGYKHAKADNNGDSKQTKYVETVNQRYAEIQETGQTIGQHFYLELLHSKVESGNGPYYTYRIKDKVFPRAAYIAEFDQIIKVQKAYYPEVLTDELIDTLRNRIIFYQRPLKSCKHLVSLCEFEMKPYKTKEGKIVYGGPKCAPRTSPLAQLCAMWETANNITLTNRNNEQYDFSLDERRQLVEHLCTHEVLKLTDLYKILGITKKDGWYGGKAIGKGIKGNATLNQLRKALNGKYGEWLEMPIEHIDAVDNETAEVFWQVSPKVEETPLFRLWHAVYSIQDADELAQTLRNKFGITEQEVIDALCKIDFVKPGYANKSHKFIRRLLPYLMDGMMYSEACKLLRINHSNSMTTEERDARPLAERIELLPKNALRQPVIEKILNQMINLVNRLQQEYGPIDEARVELARELKQSREEREGAYRRNNQNERLNKEIFAKIEEMGIRPSRSRIQKYKMWEESNHRCMYCGKTVSLAEFLNGAEVEIEHIIPRSILFDDSFSNKVCACRECNHEKGNLTALDYLETKPTAEQEAYKQRVDEAFKEGRISKTKRDHLLWHRSDIPTDFIDRQLRQSQYIAVKAVEILQQGIRQVWTSGGSVTDFLRHLWGYDEILHTLNLPRYRQVEELTEIVHYEHAGQEHDEERIKNWSKRIDHRHHAIDALTVALTRQAYIQRLNSLNAEFTREEMLKEVEEANTVYNEKKSLLEKWVNEQPHFSVDDVTQSVDSILVSFRAGKRVTTPARRAIYQGGKRTIVQRNIQVPRGALTNEFVYTKNGNKYARKYPIDAISNPENIVDPTIRQLIKARLAAFNGNAKEAFKEPLFSAEGMEIRTIRCYNNKLADKGVVAVKYNERQEPIGFSETDSNHHIAIYRDKSGKYQEMVVSFWDAVERKKFGVPVVISNPHDVWDSIMDKDLPQEFLVKLPKDDWTYILSMQENEMFVLGMEEDEFNDAIEAKDNAVLNKHLYRIQNISSLFYNFRYHTETKVDDKYAGIENGRNASMSLGALVPIRSFGSLFALFPHKVKIDIMGRITKA

SEQ ID NO: 1336 - protein, 943 aa, Unknown
  Description of Unknown: uncultivated organism with predicted taxonomy: Bacteroidales
  MG16-258 effector
VLTDELIDTLRNRIIFYQRPLKSCKHLVSLCEFEMRPYKTKDGRIVYGGPKCAPRTSPLAQLCAMWETVNNITLTNRNNEKLDITLDQRKQMVDFLCSNKELKLTNLYKILGISKKDGWYGGKAIGKGIKGNATLLQLREALGGKYDQWLEMPIELKDSKWVDAETGEVMKEVTEAVEQTPQFRLWHAVYSLQNVDELAKTLRTTFQITDEAVIEALCKIDFVKPGYANKSHKFIRRLLPYLMDGYQYSEACAHIGINHSNSMTAEERDERPLAERIELLPKNALRQPVIEKILNQMINLVNRLQQEYGPIDEARVELARELKQSRDERDSAYKAINKNERENAAIAAKIAEFGIRSSRSRIQKYKMWEESSHRCFYCGKTMDITQFLSGADVEIEHIIPRSILFDDSFSNKVCACRECNREKGNMTAMEYMEHKPAGEFEAYKQRVDEAFTDHRISKTKRDHLLWRRADIPQDFIDRQLRQSQYIAVKAVEILQTGVRRVWTSGGSVTDFLRHQWGYDEILHTLNLPRYRQVEALTEIVHYEHAGQEHNEERIKNWTKRTDHRHHAIDALTVALTQQSYIQRLNTLEASHDWMEKQVKEANTPYNEKKSVLERWVADQPHFSVAEVTDKVDGILVSFRAGKRVTTPARRAVYRGGKRTIVQTGLLVPRGALTEDTIYGKCEDGFVVKYPLDHPTMKPENIVDPTIRRLVEKRIAAYGGNTKEAFKTPLYSAEGMEIKSVRCLTNLSEKGVVPVKYDKTGQPIGFAKKGNNHHVAIYKSDNDKPFDQVVSFWDAVERKRYSVPIVIDNPHEVWDGLLNRDMPQEFLDKLPHDDWQFVLSMQENEMFVLGLEDDEFNDAIERQDYNSLNKHLYRVQKITHNDYWFRFHTETTVDDKYGDQENQVVNVAWSTEMKKVFRFKSQGALFAQFPHKVKIDIMGRITKA

SEQ ID NO: 1337 - protein, 921 aa, Unknown
  Description of Unknown: uncultivated organism with predicted taxonomy: Prevotella saccharolytica
  MG16-259 effector
FVNNIRLENGYKEARALSQDERLKVVDYLDNHEKMTARDFTKLLGLDKNDEWDLKKYFGKNGVQGNITKTQLATALANVSNASELLRFNLALENSNYVNESTGEVLKVISSDFQNEPLYMLWHTVYSLSDKEELKNALNKKYGITDESVLNNLFKIDFVKPGFGNKSAKAIRRILPFLQDGLVYSDACAEAGYNHSNSLTKSENEARTLLSRLPQIKKNELRQPVIEKILNQMVNVVNAIYDEYGQIDEIRVELARELKQSKDERNTTASNIAKRERENKNIEAKIQEFGIRSSRNRIQKYRLWEESEQKCFYCGQPVQAKEFLSGLDVEVEHVIPKSLLFDDSFANKVCACRKCNAAKGNKTAYDFMKGQKEEVFDAYVKRVNDFYKDGKISKTKKERLLTTQSEIPSDFIERQLRQTQYIAKKALEMLKDVCYNVYATSGSVTDFIRHTWGYDEILHQLNYDRYKKGGLTEFREYDHKGETHTEERIQDWSKRLDHRHHAIDALVIAMTRQSIIQRLNHLNTERDAMFQEVEKQRKEWKNDYSMLQEWLRERKHFSAEDVAKKVSDILVSFKAGKRVATIGKRVKYEHGKKNVLQTGIVIPRGPLSEESVYGKIKVLDRNKPVKHLFENPESIVNADIKSAVTNRLIQNKSDVKKAVQSLKKSPIVLANGKTLENADCYKEEYVIKYSLNGFKAKDIDSIVDTHIKDVLYKRLEEYNGNEKEAFKDIENNPIYADAAHKIKIRNVRCFTGLSAVVPVKKDENGNAIGFVKPGNNHHVAIYKDENGNLQESVATFWHAVERKKYGLPIVITNPIDAWKLARERNCPKEFLDCLPKENWTFVQSLQINEMFVMGLTNEAYEKAVAEKDYALLNQYLYRVQKLTSNDYFVRYHLETVLDDSAEARSIKKFYRFKSLGSLFKE

SEQ ID NO: 1338 - protein, 777 aa, Unknown
  Description of Unknown: uncultivated organism with predicted taxonomy: Bacteroides sp. CAG:770
  MG16-260 effector
LYITHEQRSAIVEHLEHNKDIKLTAIQKILGIGKSKEWFIKKEQLKPLQGDITRIKLAEALSSGHLSKEKIENLLLLKIDFEEMADTTTGEVMGGIVVKNNIESQPFYQLWHAIYSIDDEKALRKTLAKLGIDDDDVMDALCKISFKTSGYAKKSTRAIKKILPYLMEGYQYSDACQMAGYNHSNSITKEEEASRPLQDHIPQIQKNELRQPVVEKILNQMINIVNTLLKDGPIDEIRVELARELKRSKDEREMANIRMNRNKRRNDEIASIIQNEYGLIPTKNRIMKYKMWEETDGFCIYCGTKIKLAEFLGGVDSEREHIIPKSLLFDDSFSNQSCACRKCNKEKGNRTALDYMRDIGKEKQYVEHIAELLEKDKISKTKYSNLLASYKDYLERKAKGKETEEDKNLWENFIDRQLRLSQNIARSAMELLRQVCHNVYATSGSVTDFVRHQWGYDNILHDLNFSRFAKSGNTEFITVVGADGKETQQERIKGWSKRMDNRHHAVDALAIALTTQSMIQRINNLNASREFMQKDVEASKEKFKEKKSLLEKWVAIQPHLSYGQAKDAISGILVSQRSGKHITTPGKRYEYKGGSKILRQQGLVVPRTALHDEFVYGRISRYDKNGILQPEIVRKYGILGGMGCLFDGKETYKETEKTDKKIGLPKIKIEDKIKDVLDKIVDGGVRKRILERLNRGFEEGKDYRNDTKKALDNLRNLDEDPIYLDDAHTIPIKTVRKFTHSTKAIPLRYNDKNEPIAFVEPGGNHHVALYETADGTV

SEQ ID NO: 1339 - protein, 934 aa, Unknown
  Description of Unknown: uncultivated organism with predicted taxonomy: Bacteroidales
  MG16-261 effector
ATEGHKLSLPELGRILYHINQKRGYKHAKADEAGDKQQTEYVAAVNSRHAMIKERHQTIGQYFAEEIRKSEIISEKGKFYTFRTKEKVFPRKAYEEEFDKIIATQRQFYPTVLTGTTINRLRNEIIFYQRKLKSCKHLVSLCEFEKHEYKNKEGKTVFDGPKVAPRTSPLAQICRIWEFVNNISLENGYKERKELSLEEKQKVVNFLDNNDKMTATDFSKLLGLGKKNGWDLKRYFGKNGVKGNETKVSLRNALKNLPNVEDLLRFNPTLDNSNYVNEATGEVLKVISPSFQNEPLYELWHTVYSLSDKDDLSNALNKKFGISDENAVQKLFKIDFVKPGFSNKSAKAIRRILPFLQQGLMYSEACAEAGYNHSNSLTKTGNEARVLLERLPQIKKNELRQPVVEKILNQMVNVVNAIYDDYGAIDEIRVELARELKQSKDERNTTFNNIAKRERENKGIAERIKNEYGLIPNRNKIEKFRLCEESDHKCFYCGQAVNAKEFLLGSDVEVEHVIPKSLLFDDSFANKVCACRKCNAQKGNKTAFDFMKSQSEDEFNNYVSRVEEYYKNGKISRTKHDRLLTPQTEIPSDFIERQLRQTQYISKKALELLREICHNVYATSGSVTDFIRHTWGYDEILHQLNFDRYKQSGLTEIREFDNKGEIHKEERIQKWNKRLDHRHHAIDALVIAMTKQSIIQRLNHLNTERDAMFQEVEKQSIEWKNDFSLLQEWLRERKHFSTKDVANRVANILISFKAGKRVATIGKRIKYEKGQKKVLQEGIVIPRGALSEESVYGKIKVIDPHKPLKFLFENPQTVISPQIKAAVVNRLSKFENDFKKTIVSIKKEPLTLASGKVINDADCYKEEYVIKYPLEGFKAKDIPYIIDKRIREVVEKRLSEYDGNEKNAFKDLENNPVFVDANHKISIKHIRCFTGLSA

SEQ ID NO: 1340 - protein, 821 aa, Unknown
  Description of Unknown: uncultivated organism with predicted taxonomy: Porphyromonas catoniae
  MG16-262 effector
SIGWCLIEKDDNNVPKRILRIGSRIVPISSDEETGYTKGNAISKNADRTAKRTARKCYDRYQLRRQALVNLLKRLGMEPNKNLMLEQTPMELWQKRADAASKEISLEELGRVLLHINQKRGYKHSRLSNSDSKETAYVQEVNSRYNDLKAEGLTIGQHFAAKLKENEQKSTDGKKYYNYRIKEQVYPRHAYEEETKKILEVQSRYHSDVLTPDVRNEMMETIFYQRDLKSCKNLVSLCEFESYTITKDGKEITIGPKVAPRTSPLAQLSSILETANNITIRNRRNDELYISPEQRKAIADFLDNHEVMKLTDLYKILNIGRKDGWWAGKAIGKGLKGNTTKCQIREALSALPKEQVDSLTAFQLEFDEYVDEETGEVRKRINNTQAEQQPLYKLWHMLYSIKDNTELSGALNHLGIEDNESIEKLCKLDFRTAGYANKSAKAIGRILPYLMEGVMYSQACERAGLDHSRRIDPNRPMLKRLPQIQKNELRQPVVEKILNQLVNIVNALLEEEGAIDEIRVELARELKQSKDERNETFKRNNQNERQNKEYAGRIKEYGLTPTRNRIMKMKMWEESEYTCMYCGQPVNVTEFLKGADVEREHIIPKSLLFDNSFTNQVCSCRRCNSKKGMRTAYDFIADDKGQEGLNAYIDRINNLFDKKKISRSKFNRLLVSHKAYISRKAQGKETEEDIELWENFIDRQLRQSQYIAKKSVEMLLQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDEMLEELNGK

SEQ ID NO: 1341 - protein, 973 aa, Unknown
  Description of Unknown: uncultivated organism with predicted taxonomy: Sediminibacterium sp. C3
  MG16-263 effector
MLKRLGIEPNKKLMLEQAPLELWQKRADAVSTKIALEDLGRVLLHINQKRGYKHSRLNNSDSKETAYVQEVNNRYDELKAEGLTVGQHFAAKLKDNEQTSADGKKYYNYRIKEQVFPRHAYEEEAKKILETQSRYYPDLLTPDVCKEIMNIIFYQRDLKSCKNLISYCEFESYTITKDGKEITIGPKVAPRTSPLAQLSSILESANNITIRNRKNDELYISPEQRKALADFLDNHEVMKLSDLYGILNIGRKDGWWAGKAIGKGLKGNTTKCQIREALKNLPQEKINALTSFNLEYDEYVDEETGEVRKRVNNHLAERQPLYRLWHLIYSIKDSDELAAALRRFGIDDEESILNLCNLDFRTPGYANKSAKAIGRILPYLAEGVMYSDACNMAGFDHTRRLNPNRPLLTSLPQIQKNELRQPVVEKILQQVVNIVNTLIEKEQSIDEIRVELARELKQSKDERNETFRRNSQNEKKNKEFAEHIKEYNLTPTRNRILKWKLYEESDHSCMYCGQSINIRDFLQGADAEREHIVPRGLLFDNSFTNQVCACRSCNSKKGMRTAYDFIEDEKGEEGLHSYIEHINYLFNKKNISRSKFNRLLVSHKAYLKRKALGKETEEDKELWENFIDRQLRLSQYIAKKSVEMLQQVCRNVYSTSGSVTDFVRHQWGYDELLHDLNFERYKRAGLTAMVTQLRSGKEVEVERIKDWTKRLDNRHHAVDALAIACTTQGMIQRLNTLNASREDILDELNKTEERNDDSERSMLEKWICSQPHISYAEAKDELDKIIISQRPSTRLTVPGKRYVKKDGKRTPVQAGILVPRGALHAEFVYGRIMKYGADGVTLTPQYVRKYKMGIGAQGYLFSGKEFYKEEQKKDSKTGQTSTVVTDKIKEVLDKVVDGGIRRRILERLNRGFEDGKDYRSNVPQALANLKNLDEDPIYSDDAKTRRILTVRKYVASSTMVAIRKDADGKPLAF

SEQ ID NO: 1342 - protein, 906 aa, Unknown
  Description of Unknown: uncultivated organism
  MG16-264 effector
QDGWWGGKAIGRGLQGNTTKIALKNALGDFDNAEKLLQFNLKNTDSGLIDEVTGEVIQMIDAKVEKEPLYDLWHTVYSISDKAELANALKKKFNIYDEDIINSLYAIDFVKQGFGNKSAKAMRRILPYLQQGMKYSDACEYAGFSHSDSLTKTENEARQLLEKLPPIQKNALRQPIVEKILNQMINVVNALMVEYGQFESIRVELARELKQSKDDRNTTFLQNEAMEKLNEAIAKRLTSEGITPTKRIMEKYKFIFPTKGCIDKKTGKFVTKNFDALATVNQCIYCGKPFSLSAALNGEGYEIEHIIPRDMICDNSQSNKVLSCRSCNSKKSNKTEFDFMRSQDKAVFDDYIKRVEKWFDDGIISPSKRERLLLSHEDYLERKKKGKTTEEDKKYWEEFVSRQAGETQYISRESIRILKQCCRNVNATSGTVTATLRHLWGYDEILHQLNFERYKQAGLTETVTWTSNHGKNEHSKEQIVDWSKRIDHRHHAIDALVVACTQQGFIQRINTLNADDTKDLMRKQIESAGIKFEEKKVLLDKYLASFVPFTTKVVADEVNKILVSFKAGKKSASTGKRIKYVKRKKEVLQEGVIIPRGALHEEGVYGQIEINGEKVIVKKYKLGKGAQGFVFTGKETYEEKVNKKTGEVQVDDKIKNVLDSIVDGNIRAKVLQRLNQGFEEGKDYRNDVKKALDNLNNLDKNPIFADENKTIPIRTVRCRTGLSAVVPVKRNEQGEPIGFVKPGNNHHIAIYRDKEGQLQEHTVTFWHAVERKKYGLPVIIENPTEVWDSIMDRQLPESFLEKLPDVNWTFEMSLQQNEMFVLGMEDETFENAIREKNYSMIGAYLYRVQSISESDYWFRLHIETQNDKTPSAKLAMKYHRVKSLKAFYGLNPHKVYVSVIGKMKEL

SEQ ID NO: 1343 - protein, 992 aa, Unknown
  Description of Unknown: uncultivated organism
  MG16-265 effector
MNIIFYQRDLKSCKNLVSLCEFESYAITKNGKEITIGPKVAPRTSPLAQLSCILETANNITIRNRKNDELYISPEQRKAIADFLDNHEIMKLTDLYKILEIGRKDGWWAGKAIGKGLKGNTTKSQIRKALSSLPKEQVDSLTAFQLEYDEYVDEETGEVRKRINNALAEKQPLYRLWHLLYSIKDVDELSGALRHIGIEDDESIQKLCNLDFRTAGYANKSAKAIGRILPYLMEGLMYSEACERAGFDHSRRINPERTLLTSLPQIQKNELRQPVVEKILNQLVNIVNALLEKEGHIDEIRVELARELKQSKDERNETFKRNSQNERKNKEYAERIKEYGLTPTRNRIMKMKMWEESEHSCMYCGQPVDVKEFLQGADVEREHIVPRGLLFDNSFTNQVCSCRRCNSQKGMRTAYDFIEDDKGEAGLNSYIEHINYLFDKKQISRNKFNRLLVSHKAYINRKAQGKETEEDKELWENFIDRQLRQSQYIAKKSVEMLQLVCRNVYTTSGSVTETVRRLWGYNELLHDLNFERFKKAGLTTMVTQLHSGEEIEVERIKDWTKRLDNRHHAVDALAIACTTQGMIQRLNTLNASRDDMLKELNSQEQRVVDPEHSMLEKWIYTQPHISYVQAKEAIEKIIISQRPNTRITVPGKRYVTKNGKRTLVQTGIVVPRGALHAEFVFGRIMKQEADGKILTPQYVRKYKLGIGAQGFLFNGKEFYKEELKKDSKTGLSTIVVTDKIKDVLEKIVDGGIRKRILERLNRGFGEGTDYRANVAKALDNLKNLDEDPIFSDDAKTRPIRTVRKYVSSTTMVAVRKDSEGQPLAFVEPDGNHHVAFYKDEDGVITESIVTKWQAVQRKLNHIPIIIDNPSQTWNEVIGRNDIPDELLQTLPKDKSTLMLSLQIGEALIMGMEEADYQKAIEEKNMLALAEHLYFVQNISIGNYRLRRHVETSYDVKDMNKEDLRFLNIASIAALFNYNPHKVKITVLGDIIP

SEQ ID NO: 1344 - protein, 960 aa, Unknown
  Description of Unknown: uncultivated organism with predicted taxonomy: Porphyromonas sp. oral taxon 278
  MG16-266 effector
RKHQMLPDEHLIKLPVLDLWTLRANAATEGFKLSLPEIGRVLYHINQKRGYKHAKADEAGDKKQTEYVENVNKRFAMIKDLGLTIGQFFASKLKESEVVSEKGKFYTYRTKEQVFPRGAYIAEFDQIIEVQRKFYPQVFTDEFINRLRNEIIFYQRNLKSCKHLVSLCEFEKHEYKNKDGKIVFDGPKVAPRTSPLFQICRIWEFVNNIRLENGYKEARTLSQDERLKVVDFLDNHEKMTAKDFTKLLELNKNDEWDLKRYFGKNGTQGNTTKTQLATALANIPNASELLQFNLTLENSNYVNEKTGEVLKVVSSDFQNEPLYMLWHTVYSLSDKEGLKNTLNKKYGITEESVINNLFKIDFVKPGFGNKSAKAIRRILPFLREGLVYSDACVEAGYNHSDSLTKSENEARTLLSRLPQIKKNELRQPVIEKILNQMVNIVNAIYDEYGQIDEIRVELARELKQTKDERNTTASNIAKRERENKNIEAKIQEFGIRSSRNRIQKYRLWEESDQKCFYCGQPVQAKEFLSGLDVEVEHIIPKSLLFDDSFANKVCACRKCNAAKGNKTAYDFMKGQKEEVFDAYVKRVNDFYKDGKISKTKKERLLTTQSDIPSDFIERQLRQTQYIAKKAIEMLKDICYNVYATSGSVTDFIRHTWGYDEILHQLNFDRYKKGGLTELREYDHKGETHTEERIQNWSKRLDHRHHAIDALVIAMTRQSIIQRLNHLNTERDAMFQEVEKQSKEWKNDYSMLQEWLRERKHFPTEDVAKKVSDILVSFKAGKRVATIGKRVKYEHGKKIVLQTGITIPRGPLCEESVYGKIKVLDRNKPLKYLLENPQYIVNADIKFAITNRLAQYENDVKKAVQSLKKSPVVLANGKKLENADCYKEEFVIKYSLNGFKAKDIDSVVDNRIRNVLYKRLEEYNGNEKEAFKDIENNPIYADATHKIKIRNVRCFTGLSAV

SEQ ID NO: 1345 - protein, 765 aa, Unknown
  Description of Unknown: uncultivated organism
  MG16-267 effector
ILPYLMEGVMYRQAWERAGLHHSRRIDPNRPMLKRLPQIQKNELRQPVVEKILNQLVNIVNALLEEEGAIDEIRVDLARHLNKNKYQRNETFKRNNQNERQNKEYAGRIKEYGLTPTRNRIMKMKMWEESEYTCMYCGQPVNVTEFLKGADVEREHIIPKSLLFDNSFTNQVCSCRRCNSKKGMRTAYDFIADDKGQEGLNAYIDRINNLFDKKKISRSKFNRLLVSHKAYISRKAQGKETEEDIELWENFIDRQLRQSQYIAKKSVEMLLQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYVAKNGKRTLAQTGIIVPRGALHAEFVYGRIMKQETDGMTMTPQYVRKYKLGIGAQGFLFNGKEFYKEELKKDSKTGLSKIVVTDKIKDVLEKIVDGGIRQRILERLNRGFEEGTDYRANVAQALANLKNLDEDPIYSDDAKTRPIRTVRKYVSSSTMVAGRKGDNGKPVAFVEPDGNHHVAFYKDENGVITETIVTKWQAVQHKLYHIPIIIDNPSQTWSEVLGRNDVPEELLQSLPKDSSTFLLSLQIGEAFIMGMEDADYGRALEGKDVQSLAEHLYFVQNISSNNYRLRRHVESSFDTTDMNKEDQRFLNISSLDALFRINPHKVKLTVLGDIIP

SEQ ID NO: 1346 - protein, 983 aa, Unknown
  Description of Unknown: uncultivated organism with predicted taxonomy: Prevotella
  MG16-268 effector
VFKKRHNHKKFQSIREPSLFDDMDILDNDILYITQEQRHSMFEYMETHDRLKLCDVLRILGLNEHSGWYAGKAIGVGLQGNTTKNTILKALRTLPKEKRDMITRFELKITSRNEINENTGEVIRHIDSSYTDEPLYRLWHIIYSIQNDEERRNAISKFLQSFDIVDEVVVDKLCGIDFVKAGYGNKSAKAISKLLPYLMDGINYSDACEYVGYRHSDYLTKEENIDRELKDIIPAIKKNALRQPVVEKILNQTINIVNAVNRELRENGQGQVDIIRIELARELKMDRESRHRKFTQNNSRKRQNEEYADKINEHGIIPTRNRVIKYRLWEEANMQCFYCGQPINITELLRDPTIEKEHIIPKALLLDNSYSNLVCSCRKCNQEKGARTAYDYMRQKSDLDAYIKRINKLAETQKISQTKRLHLLASYEDYLVRKRLGKATEEDRNLWEEFINRQLSLSQYISRKAMEILQTGCRKVYATSGSITDIERHLWGYDTILHELNFPRYKCAGLTTVIKEEYEEGIITEKEVITNWSKRKDNRHHAIDALVIACTTQDTIQRINTLHASRDELQKETSGNPVFYSEKSTLLERWIKGKQPIPRHEVLEQVKQIAISIKAGKKVTTPGKRKTYKQGKPKLIQTGLLIPRGQLHEETIYGQINVPVKTKNGTIRQEPKSVVRYKLGCGKGFVFSGKETCKVEKDKKTDEYFITDEIDKALSYIVDKHIREVIRQRLNRPFPEGETYRTKAEQAQKDGRIYDGEEECKQALQGIRNLDIDPLFADKDGRIPILRVRCFTGLTLLQPLRYNSEGKPISFVSLGNNHHIALYKQTNGDIVEHVVTFWHAVERSTRGIPIVIKRPDDVWNDILNKPSDELPESFLNQLPYPNATYITSMQQNEMFILGMSQDEYQDAIACNNQTELCRHLYRVQSLSTNQYYFRLHIESENDKTLAGMKAGKFIRCKSIGSFLRLNPHKVTVTLLGKIIINNS

SEQ ID NO: 1347 - protein, 992 aa, Unknown
  Description of Unknown: uncultivated organism with predicted taxonomy: Bacteroidales
  MG16-269 effector
MDIIFYQRDLKSCKNLVSLCEFESHTITKDGKEITIGPKVAPRTSPLAQLSSILETSNNITIRNRRNDELYISPEQRKAIADFLDNHEVMKLTDLYRILNISRKEGWWAGKAIGKGLKGNTTKCQIREALGSLPKEQVDSLTAFRLEFEEYVDEETGEVRQRVNNTLAEQQPLYKLWHMLYSIKDNKELSGALHHLGIDDEKSINKLSNLDFRTAGYANKSAKAIGRILPYLMDGIMYSEACERAGFDHSRRINPGRTLLTSLPQIQKNDLRQPIVEKILNQLVNIVNALLEKEGTIDEIRVELARELKQSKDERNEAFKRNNQNERQNKEYAERIKEYGLTPTRNRIMKMKMWEESEYTCMYCGQPINVTEFLQGADVEREHIIPRALLFDNSFTNQVCSCRRCNSQKGMRTAYDFIADDKGQEGLDLYIERINDLFDRKKISRSKLNRLLVSHKAYVSRKAQGKETEEDKELWENFIDRQLRQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLSACRNEMLDELNSKDERVIDPERSMLEKWINSQPHICYAQAKDEVDKIIVSQRPNTRITVPGKRYVTKNGKRTQAQTGIIVPRGALHAEFVYGRIMKQEADGMTLTPQYVRKYKLGIGAQGFLFKGDETYKEDVKKDKKTGLSQIVVTDKIKDVLDKIVDGGIRRRILERLNRGFEEGTDYRANVAKALANLKNLDDDPIYSDDAKTRPIRTVRKYVSSSTMVAVRKNDDGKPISFVEPDGNHHVAFYKDEDGVVTESLVTKWQAVQRKLNHIPIIIENPSQVWNEVLGTNDIPNELLQSLPKDKSIFLLSMQIGEAFVMGMDETAYKRAIEKNDTQALADHLYFVQNLSSNNYRLRRHVESSFDTTDMNKEDLRFLNVKSIGALFNYNPHKVKLTILGDIIL

SEQ ID NO: 1348 - protein, 1159 aa, Unknown
  Description of Unknown: uncultivated organism with predicted taxonomy: Bacteroidales
  MG16-270 effector
MKKKVLGLDLGVGSIGWALIETTDNQPEEIVGMGCRIVPIGKDDSDQFSKGQAISKNADRTARRTARKGYDRYQLRRALLTQVLRQNGMLPERMDENVIDLWKLRSDAATEGEKLTLPQIGRVLYHINQKRGYKHAKADDSADKKQTDYVAAVNQRYADLQAENKTIGQHFYLELLRSKVEGASGPYYTFRIKDKVFPRAAYIEEFDQIMHVQRTYYPTILTDELIDTLRNRIIFYQRPLKSCKHLVSLCEFEMRPYKTKDGRIVYGGPKCAPRTSPLAQLCAMWETVNNITLTNRDNEKLDITLEQRKQMVEFLCANKELKLTNLYKILGISKKDGWYGGKAIGKGLKGNATLLQLREALGGKYDQWLEMPVELKDSKWVDTETGEVIKEVTEKIEQTPLFRLWHAVYSLQNADELAKTLREKFQITDKAVIDALCKIDFVKPGYANKSHKFIRRLLPYLMNGYQFSEACARIGINHSNSMTAEERDSRTLVEQIELLPKNALRQPVIEKILNQMINLVNRLQQEYGPIDEARIELARELKQSREERDNAYKAINKNERENAAIAAKIAEFGIRPSRSRIQKYKMWEESNHRCFYCGKTMDIAQFLNGADVEIEHIIPRSILFDDSYSNKVCACRDCNREKGNSTAMEYMEGKPTGEFEAYKQRVDEAFTEHRISKTKRDHLLWRRADIPQDFIERQLRQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSVLERWVADQPHFSVADVTDKVDGILVSFRAGKRVTTPARRAIYSGGKRKIVQTGLQVPRGALTEDTIYGKREEGFVVKYPLDHPSMKVENILDPTIRNLVKEHIVAFGGNAKEAFKMPLYSAKGMQIKSVRCKTNLSENSVVPVKVNADGQPIGYAKKGNNHHVAIYQDKKGEYQELVVSFWDAVERKHYGVPVVIINPHEVWTDLVNKDLSQDFLNKLPHDDWQFVLSMQENEMFVLGLEDDEFNDAIERHDYNLLNKHLYRVQNISNKDYSFRYHTETKVDDKYDGIENGRSTSMTLGALFRFKSISGLLSHFPHKVKIDIMGRITKA

SEQ ID NO: 1349 - protein, 1161 aa, Unknown
  Description of Unknown: uncultivated organism with predicted taxonomy: Bacteroidales
  MG16-271 effector
MTKKILGLDLGVGSIGWALIETQDDKPSQILGIGSRIVPISNDDSDQFQKGQAITKNAERTQRRTARKGYDRYQLRRALLTNLLREKNMLPDYMNESAIDLWRLRSDAATEGKKLSLKEIGRVLYHINQKRGYKHSKADVSADSKQTKYVQEVNKRFQELKELGQTIGQHFYQMLQQSVVQSEKGVYYTYRIKDKVYPRRAYEEEFDKIMSTQKVFYPDILTDEFIDTLRNRIIFYQRPLKSCKHLVGLCEFEMRPYKKADGSIVYSGPKCAPRTSPLAQICAVWEAVNNIKLTNRNNEIYPISQEERQAMVDFLQTHKEMKVADMQRILGIKKSDGWWGGKAIGKGIKGNQTLCQLREALGEKYQELLKMEIKKIDSGFFDAETAEVIEIIDPACENEPLFQLWHVVYSVQDKDELRKALLKKFNIDDEQVVENLYNLDFVKPGYANKSHKFIRRILPYLMQGEMYSVACARVGINHSNSRTKEELNTRPLVEHIKLLQKNTLRQPVIEKILNQMINIVNALRDKYGEIAEVRVELARELKQNKEERETTYKNNSKNERLNREITERIKEMGIRPSRMRVQKYKLWEESLHQCFYCGKTVGAAEFLSGADVEIEHIIPRSVLFDDSYSNKVCACRECNHAKNNQTAFDFMKAQSTDKFEAYKSRVDDAFKEKRISKTKRDHLLWGLEDIPQDFIDRQLRQSQYIAAKAVEILQTAIRDVHATSGSVTELLRHQWGYDEILHHLNLPRYNKADLTEIVQYDHAGQKHTVERIKNWNKRLDQRHHAVDALTIALTKQSYIQRLNTLNASRETIYNEVEQADAKLRNEEKRTLLENWVAIQPHFPVKDVEDKVAGILVSFRAGKRVTTPAKRAVYRNGKRINVQKGLLVPRGALTEETVYGKLGDRFVVKYPHQHPSMSPDNIVDPTIRELVKKRLSEFNNDPKQAFATPLYSDKAQKMEIKSVRCFAPGVSAQGSTPVRFNNDGNPIGYSKTGNNHHIAIYKDANGKYKESVVSFTEAVHRKLIGLPIVIDNPKQVWDKVINMNLPEDYLLTLPQDNWEFVVSMQVNDMFIMGLTDVEFEDAIHEKDYALLNQHLYRVQKLSSTKYYFRYHLETSVDDKYDGVANEKLSMEIGKLINLRSPNAMAVNVHKVRISILGEITPL

SEQ ID NO: 1350 - protein, 763 aa, Unknown
  Description of Unknown: uncultivated organism with predicted taxonomy: Bacteroides sp. CAG:770
  MG16-272 effector
EAYTIKKDGKEITIGPKVAPRTSPLAQLSSIFETANNITIRNRRNDELYISPEQRRAIADFLDNHEVMKLTDLYKILNIGRKDGWWAGKAIGKGLKGNTTKCQIREALSILPKEQVDSLTAFQLEFDEYVDEETGEVRKRINNARAEQQPLYKLWHLLYSIKDNDELSGALRHLGIEDEESIEKLCKLDFRTAGYANKSSKAIGRILPYLMEGVMYSEACERAGFDHSRRINPDRILLTHLPQIQKNELRQPVVEKILNQLVNIVNALLEKEGAIDEIRVELARELKQSKDERNEAFKRNNQNERQNKDYAERIKEYGLTPTRNRIMKMRMWEESEYTCMYCGQPVNVTEFLKGADVEREHIIPRGLLFDNSFTNQVCSCRRCNSKKGMRTAYDFIADEKGQEGLDTYIDRINDLFNRKKISRSKLNRLFVSYKAYMSRKAQGKETDEDKDLWENFIDRQLRQSQYIAKKSVEMLQQVCKNVYTTSGSVTDFVRHQWGYDELLHELNFERFKKAGLTAMVKQLHSGKEIEVERIKDWTKRLDNRHHAVDALAIACTTQGMIQRLNTLNASRDEMQEELSSKEQRLVDPERSMLEKWIFAQPHISYAEAKNEIDKIIISQRPNTRITVPGKRYVTKNGKRTLAQTGIIVPRGALHAEFVYGRIMKQEADGVTMIPQYVRKYKLGIGAQGFLFNGKEFYKEELKKDSKTGLSSIVVTDKIKDVLEKIVDGGIRQRILERLNRGFEEGTDYRSNVAQALDNLKNLD

SEQ ID NO: 1351 - protein, 1016 aa, Unknown
  Description of Unknown: uncultivated organism with predicted taxonomy: Bacteroidetes
  MG16-273 effector
VLLHINQKRGYKHSRLSNSDSKETAYVQEVNSRYDDLMAEGLTIGQHFAAKLKENEQESIDGKKYYNYRIKEQVYPRHAYEEEAKKILEVQSRYHSDVLTPDVCKEMMGIIFYQRDLKSCKNLVSLCEFESYTITKDGKEITIGPKVAPRTSPLAQLSSILETANNITIRNKRNDELYISPEQRKAIADFLDNHEVMKLTDLYKILNIGRKDGWWAGKAIGKGLKGNTTKCLIREALSALPKEQVDTLTSFQLEFDEYVDEETGEIRKRINNTLAEQQPLYKLWHMLYSIKDNTELSGALHHLGIEDKESLEKLCRLDFRTAGYASKSAKAIGRILPYLMEGVMYSEACERAGLDHSRRIDPNRTLLTHLPQIQKNELRQPVVEKILNQLVNVVNALLEKEGAIDEIRIELARELKQSKDERNETFKRNNQNERQNKEYAERIKKYGLTPTRNRIMKLKMWEESEHACMYCEQPVDPIEFLKGADVEREHIIPRGLLFDNSFTNQVCSCRRCNSKKGMRTAYDFIADDKGQEGLNAYIEHINDLFDKKKISRSKLNRLLVSHKAYISRKAQGKETEEDKELWENFIDRQLRLSQYIAKKSVEMLQQVCKNVYATSGSITDFVRHQWGYDELLHDLNFERFKKAGLTTMVKQLHSGEEVEVERIANWTKRLDNRHHAVDALAIACTTQSMIQRLNTLNASRDDMLEEQNSKDQRLVDPERSMLEKWVFIQPHITYADAKKEIDKIVISQRPNTRITVPGKRYITKNGKRTLVQTGIIVPRGALHAEFVYGRIMKRDIDGVTMTPQYVRKYKLGIGAQGFLFNGKEFYKEELKKDSKTGLSKIVVTDKIKDVLEKIVDGGIRQRILERLNRGFEEGADYRANVAQALANLKNLDEDPVYSDDAKTRPIRTVRKYVSSSTMVAVRKDDKGKPVAFVEPDGNHHVAFYKDDNGVITETIVTKWQAVQRKLYHIPIIIDNPSQTWSEVLERNDVPDELLQSLPKDSSTFLLSLQIGEAFIM

SEQ ID NO: 1352 - protein, 951 aa, Unknown
  Description of Unknown: uncultivated organism with predicted taxonomy: Bacteroidales
  MG16-274 effector
LFITREQKQQIANIMDNKEVLKLKDVHEVLGINSKSGWYCDKAIKSGIKGNSTKCAIISALSSLPNSTIREITRFNLETETTNMVDEETGELLVRIKSTYQEEPLYRLWHIIYSIKNDAERLNTILVFLKEFGIEDVSIANALNDIDFVTPGYANLSAKAISKILPYMMEGLDYSESCEYVGYNHSDSLTKEENEKRELLDQIPAIKKNELRQPTVEKILNQTINVFNQINAELGKKGERVDEVRVELARELKQSKEEREETDKGIRKQQKANEEYADILKKKGVRPTRNRILKYRLWKESEEACFYCGRDIDFHEFLRFSDIEREHVIPKKLLFDDSFANQVCSCRRCNAEKGGRTALDYMRTKPNLQEYLDKVDKMFQEHKIGGKKHTHLLASYDDYLSRKKEGKETKDDILIWEEPIDRQLRLSQYISKKAQELLKTACREVMATSGSITDLIRHTWGYDTILHELNFPRYKDAGLTEIIKDEETGMQRELIPDWSKRLDHRHHAIDALAVACTSRSIVQRINTLHASREIIRDEIKTSRKEWEDNDLLQQWIKEKMPFDRQYVVQKVASILVSMKAGKKATVPGKRKIYKNGKPVIMQTGLRIPRGQLHEQTVYGAIKHHSKDKKGNVIETKEIVTRYKMGVGSVGFVFTGKETCDVVFDKKNERYVIVDGIGKAINYIVDRHIREIVRERINEAFPDGETYLSEAEKALAEGKPYNGKGRSQKALEQLKALDEHPLYADKNKTIVIKSVRCFTGLNAVQPLRYNSKHEPISFVLTKNNHHVAIYVDEKGEYQECVYTFWQVVERAKYRLPLIIQDPKTIWDEIRQREKDGDSFPDDLITSLPLPNWTFVESLQQNDMFVMDMDDDTFKENVTSNNYKELGEKLYRVQNLSTHDYFFRLHSDTTSKTTPDLAQCKKFIRIKSFKAYFEHNPHKVQLSLLGKIILKND

SEQ ID NO: 1353 - protein, 984 aa, Unknown
  Description of Unknown: uncultivated organism with predicted taxonomy: Bacteroidetes
  MG16-275 effector
YENKEGKIVFGGPKVAPKSSPLFQICKIWEAVNNITLKNRKNDELYITLEQRKAMVDFLDTHEKLTLKEVYSILGISKQDGWWGGKAIGRGLQGNTTKIALKNALGDFDNAEKLLQFNLKNTDSGLIDEVTGEVIQMIDAKVEKEPLYDLWHTVYSISDKAELANALKKKFNIYDEDIINSLYAIDFVKQGFGNKSAKAMRRILPYLQQGMKYSDACEYEGFSHSDSLTKTENEARQLLEKLPPIQKNALRQPIVEKILNQMINVVNALMVEYGQFESIRVELARELKQSKDDRNTTFLQNEAMEKLNEAIAKRLTSEGITPTKRIMEKYKFIFPTKGCIDKKTGKFVTKNFDALATVNQCIYCGKPFSLSAALNGEGYEIEHIIPRDMICDNSQSNKVLSCRSCNSKKSNKTAFDFMRSQDKAMFDDYIKRVEKWFDDGIISPSKRERLLLSHEDYMERKKKGKTTEEDKKYWEEFVSRQAGETQYISRESIRILKQCCRNVNATSGTVTATLRHLWGYDEILHQLNFERYKQAGLTETVTWTSNHGKNEHSKEQIVDWSKRIDHRHHAIDALVVACTQQGFIQRINTLNADDTKDLMRKQIESAGIKFEEKKVLLDKYLASFVPFTTKVVADEVNKILVSFKAGKKSASTGKRIKYVKGKKEVLQEGVIIPRGALHEEGVYGQIEINGEKVIVKKYKLGKGAQGFVFTGKETYEEKVNKKTGEVQVDDKIKNVLDSIVDGNIRAKVLQRLNQGFEEGKDYRNDVKKALDNLNNLDKNPIFADENKTIPIRTVRCRTGLSAVVPVKCNEQGEPIGFVKPGNNHHIAIYRDKEGQLQEHTVTFWHAVERKKYGLPVIIENPTEVWDSIMDRQLPESFLEKLPVVNWTFEMSLQQNEMFVLGMEDETFENAIREKNYSMIGAYLYRVQSISESDYWFRLHIETQNDKTPSAKLAMKYHRVKSLKAFYGLNPHKVYVSVIGKMKEL

SEQ ID NO: 1354 - protein, 1348 aa, Unknown
  Description of Unknown: uncultivated organism with predicted taxonomy: Clostridiales
  MG18-1 effector
MDQSKEYYIGLDGGTDSVGWAVLNPDYTVVKKRGKSLWGVRLFESGQTAAERRLARSARRRTDRKKWRLKLLKELFAEEVAACDPAFFARLAESRYWEDDKKVDGADTLFHDADFTDKDYHRQFPTIYHLRRHLMCCTEKPDIRLLYLAVAHMIKNRGHFLNEGQDLNQVRRFDDVWQNLCAAVSDVLGIELAVENGAKAAEVLTSSVKIKEKTKQLESVLGEGESEADRSVCKALAGLLAGAKVSAVDLFNGDEALKECGKFSLAEKSIEELEPDLGDALGEERFSLLQYAYAAYNWAVFARLLPEGKTISEVKTEEYEAYKADLRALKQLVKQYASDQYYRVFRSAKIKGNYASYVGKTNCGNEKSNPESCKPEEFFAFLKKELKPLWSQNIPAAASLAAKLESGTLLRRQRSGENAAIPYQAHLQELQIILKNMQQFYPFLQKADENGFTPAYKIEKLLTFRIPYYVGPLNDAHKEKGFCWIVKKADVPVLPWNFDQVVDENACEDAFIGRMSATCTYLVGENVLPQNSPLYCRFMVLNELNNLRIRSEKITPALKQAIFTQLFCAGKGGKVTQKKLLDFLHSQGIDANKQDISGIDGDFKASMAPAVKLQSIFTEPLPPEILERLAFALTVSGESHKMLQNRIRAILPNADNAVIRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGVSPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQTMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQRDPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGAAHAGILLASKNIDGKVPVSIVHQSVTGYFTQEVCLNDL

SEQ ID NO: 1355 - protein, 1379 aa, Unknown
  Description of Unknown: uncultivated organism with predicted taxonomy: Phascolarctobacterium succinatutens
  MG18-3 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRHQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGKGELFKQNPLKANSGQLPLKAGLSIEKYGGYNSLTTAYFAVVKSEGKKGAVQLSIEAIPLVYAKQGEIAVQNYLTEVVQLCKPEIMLSKIKKYSLFKINGFPMHISGRTDNRILFYGAGQLCIDEADADYLKKALKYEADIAENELVIADTNADDIQKQNAQKRLDYYNQKWRIGRKINMHIYDMLLAKSGNSLYKNRPASQTTDLQEQRDVFEKLSLADQIHVIGEVLKLFKCASASANLKLLDKGNACGVIKVSNNILKFKQCILINQSPTGVFEQKVDLMKL

SEQ ID NO: 1356 - protein, 1379 aa, Unknown
  Description of Unknown: uncultivated organism with predicted taxonomy: Phascolarctobacterium succinatutens
  MG18-4 effector
MQKLKNCDYYIGLDMGDASVGWAVTDTNYNILKFNGKALWGIRLFDSANTAASTRVFRSGRRRIDRTTWRLKMLQELFADEIAKVETGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVATILKTAYKHSEIVYVKAGNVSDFRQKFEFVKCRDVNDLHHAKDAYLNIVVGNCYHVKFTDKPMDFIKKNQDNRSYSLKPEIFYKFSIKRDSEIAWVGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEKAVQNYLTDVLQLCEPEIKIPKIKKYSLFKINGFPMHISGRQLKQLQFYVASQLCIDEYSIAYLKKAFKYENNLAVNDEIIADKNADEEKKQKARKRLDFYEKTWGIGKENNIRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1357 - protein, 1379 aa, Unknown
  Description of Unknown: uncultivated organism with predicted taxonomy: Phascolarctobacterium succinatutens
  MG18-5 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRKQFKFVKCRDVNDLHHAKDAYLNIVVGNCYHVKFTANPLNFITKNQDNRRYSLKPEIFYKFSIKRDGEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEKAVQNYLTDVLQLCEPEIKIPKIKKYSLFKINGFPMHISGRQLKQLQFYVASQLCIDEYSIAYLKKAFKYENNLAVNDEIIADKNADEEKKQKARKRLDFYEKTWGIGKENNIRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1358 - protein, 1379 aa, Unknown
  Description of Unknown: uncultivated organism with predicted taxonomy: Phascolarctobacterium
  MG18-6 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYENHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSNIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGEDGTMAIVARTMHKNNILFTRQAVEGKGELFKQNPLKANSGQLPLKAGLSVEKYGGYDSLTTAYFAVVKSEGKKGAVQLSIEGIPLVYARQGEDAIKKYLIEVVHLCNPIIKLNKIKKYSLFKINGFPMHISGRHGKQLIFYVAGQLCLDEESIAYLKKAFKYESDLAINEEIIDDKNAAEENKQKAHEKLGFYENTWGISEASNMRLYDILIAKSANNFYKNRPASQTSVLKQQRDKFAKLPLSKQIRVINEAINLFKCASATADFKLLEKGSACGKIQVSTNITKCKQCILINQSPTGVFEQEVDLMKL

SEQ ID NO: 1359 - protein, 1383 aa, Unknown
  Description of Unknown: uncultivated organism with predicted taxonomy: Acidaminococcales
  MG18-7 effector
MQNKKNVDYYVGLDMGDASVGWAVTDLNYNILKFNGKALWGIRLFDSAETAAARRGFRSARRRIDRVSWRISMLQELFAEEIAKVDAGFFQRLKDSRLQVEDKQEKTAYNLFVGQNYTDKDFYQQYPTMYHLRYALATQAGPFDVRLLYLAVQHIVKHRGHFLFENLDASKVGDFVAVFGEVESYVHDEMELDEWYCHDIDALAKVLCNANLGITAKQKAIQNLLPAKTKQEKAIVQLLSGGKAKLCDLFCDEELAECEKKSISFQEDNLDELEPILEAILQERYEALLRFKAVYDWSLLAKILRLDADKKSENEMHLLSECKVKVYEEHKKDLAVLKSMLKGKPLYNKLFRQDGEDTYANYAQGIKGINQVDFCKSLKKQLESIGEYKKQMQQLTSFEDAQTDVERLLFRVANGLAFPKQTTKDNGIIPIQVHLAELQCILAHAEKYLPFLKNADANGLSVREKITQIVKFRIPYYVGPLAGTRLSREQGRCWVERRAELKNEKIYPWNFDKVVDLEASAENFITNMTAKCTYLVGEDVLPKESLLYSEFMVRNALNNLTIDGERLPVSLLQKIYKQLFLEKTFKVTKKALERFFKQENVSYHDIGGIDDKINASMKAYNDFKRIFGEAYIEMHRDEIENIIRWITLFCDEKKMLETKIRKTYPQIPDDKIKAIKKLKYKDWGRLSATLLDSGKIAYEDASVGERITIISALRHTNKNFMELLSSNCQYDFIGKIKDFNGSKQSDNGKLTYKDVEELYVSPSVKRSIWQTLTILEEIKKIMGCEPKRIFIEMARSKEESLRTNSRLQRLQDLYKKCKEENIDFMPKADELTDIRSQLQCKNEEDLRSDKLYLYYTQMGRCMYTGERIELASLYDQNKYDVDHIYPRSKTKDDSLNNRVLVKKEINSAKTDNYPIDADIRKKMHAFWKMLYDKGFIDQKKYERLTRSTQLTDEELAGFINRQLVETRQSTKATADILKSAYEHSEVVYVKAGNVSDFRQQFDFVKCREVNDLHHAKDAYLNIVVGNCYHVKFTINPLMFIRGNQDNRRYSLKPEVFYAHDIKRNGEIAWLAGDNGTMATVKRVMQKNNVLFTRLAVEGKGELFKQNPLKAKSGQLPLKAGLSIDKYGGYDSLSTAYFALVESEGKKGAVQFTIEAIPLVYAKQGEATIKKYLTEVVQLCKPEIKVMRIKKYSLLKINGFPMHISGRTGKQLIFYVASQLCIDENSVAYLKKALKYESNLEENEAILADKNADESMKQKAFNRLEFYKNTWEISAVANLQIYDMLLAKSANNLYKNRPASQTATLKEKREQFAKLSLSKQIHVIKEILNLFKCASASADFKLLDKGTSCGTLKVSNNITKLKQCVLINQSPTGVFEQEVDLMKL

SEQ ID NO: 1360 - protein, 1379 aa, Unknown
  Description of Unknown: uncultivated organism
  MG18-8 effector
MQKSKNCDYYIGLDMGDASVGWAVTDTNYNISKFNGKALWGIRLFDYANTAASTRVFRSGRRRIDRTTWRLKMLQELFADEIAKVDTGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTVEEHLLFRITNGFAFPKQTTKDNGIIPIQVHLAELKCILDNAEGYLPFLGETNNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCKEENIDFVPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGKGELFKQNPLKANSGQLPLKAGLSIEKYGGYNSLTTAYFAVVKSEGKKGAVQLSIEAIPLVYAKQGEIAVQNYLTEVVQLCKPEIMLSKIKKYSLFKINGFPMHISGRTDNRILFYGAGQLCIDEADADYLKKALKYEADIAENELVIADTNADDIQKQNAQKRLDYYNQKWRIGRKINMHIYDMLLAKSGNSLYKNRPASQTTDLQEQRDVFEKLSLADQIHVIGEVLKLFKCASASANLKLLDKGNACGVIKVSNNILKFKQCILINQSPTGVFEQEVDLMKL

SEQ ID NO: 1361 - protein, 1379 aa, Unknown
  Description of Unknown: uncultivated organism with predicted taxonomy: Phascolarctobacterium succinatutens
  MG18-9 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1362 - protein, 1379 aa, Unknown; identical to SEQ ID NO: 1361
  Description of Unknown: uncultivated organism with predicted taxonomy: Phascolarctobacterium
  MG18-10 effector

SEQ ID NO: 1363 - protein, 1379 aa, Unknown
  Description of Unknown: uncultivated organism with predicted taxonomy: Phascolarctobacterium succinatutens
  MG18-11 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKIAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1364 - protein, 1379 aa, Unknown
  Description of Unknown: uncultivated organism with predicted taxonomy: Phascolarctobacterium succinatutens
  MG18-12 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLNDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1365 - protein, 1379 aa, Unknown; identical to SEQ ID NO: 1356
  Description of Unknown: uncultivated organism with predicted taxonomy: Phascolarctobacterium succinatutens
  MG18-13 effector

SEQ ID NO: 1366 - protein, 1379 aa, Unknown; identical to SEQ ID NO: 1361
  Description of Unknown: uncultivated organism with predicted taxonomy: Phascolarctobacterium
  MG18-14 effector

SEQ ID NO: 1367 - protein, 1379 aa, Unknown
  Description of Unknown: uncultivated organism with predicted taxonomy: Phascolarctobacterium succinatutens
  MG18-15 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDEFAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPHISDDKIKAIKKLKYKDWGRLSATLLNSSAIAYEDKAFGELVTIISALRHTNKNFMELLSSYCYYDFIGKIKEFNGSRQSSNGKLTYKDVEELYVSPSVKRSVWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSMQLRDEELAGFISRQLVETRQSTKAVAAILKTAYQNSEVVYVKAGNVSDFRQQFKFEKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1368 - protein, 1379 aa, Unknown; identical to SEQ ID NO: 1364
  Description of Unknown: uncultivated organism with predicted taxonomy: Phascolarctobacterium succinatutens
  MG18-16 effector

SEQ ID NO: 1369 - protein, 1379 aa, Unknown; identical to SEQ ID NO: 1361
  Description of Unknown: uncultivated organism with predicted taxonomy: Phascolarctobacterium
  MG18-17 effector

SEQ ID NO: 1370 - protein, 1379 aa, Unknown; identical to SEQ ID NO: 1361
  Description of Unknown: uncultivated organism with predicted taxonomy: Phascolarctobacterium succinatutens
  MG18-18 effector

SEQ ID NO: 1371 - protein, 1379 aa, Unknown; identical to SEQ ID NO: 1361
  Description of Unknown: uncultivated organism with predicted taxonomy: Phascolarctobacterium
  MG18-19 effector

SEQ ID NO: 1372 - protein, 1379 aa, Unknown; identical to SEQ ID NO: 1361
  Description of Unknown: uncultivated organism with predicted taxonomy: Phascolarctobacterium
  MG18-20 effector

SEQ ID NO: 1373 - protein, 1379 aa, Unknown; identical to SEQ ID NO: 1361
  Description of Unknown: uncultivated organism with predicted taxonomy: Phascolarctobacterium
  MG18-21 effector

SEQ ID NO: 1374 - protein, 1379 aa, Unknown; identical to SEQ ID NO: 1356
  Description of Unknown: uncultivated organism with predicted taxonomy: Phascolarctobacterium
  MG18-22 effector

SEQ ID NO: 1375 - protein, 1379 aa, Unknown
  Description of Unknown: uncultivated organism with predicted taxonomy: Phascolarctobacterium succinatutens
  MG18-23 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELSVDEELDECEKKSVSFQDDDLNEFEPVLTAALGERYEGLLRFKAIYDWSLLAKILHLDTSKKDEGEQHLLSECKVQVYENHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVVRTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1376 - protein, 1379 aa, Unknown
  Description of Unknown: uncultivated organism with predicted taxonomy: Phascolarctobacterium
  MG18-24 effector
MQKLKNCDYYIGLDMGDASVGWAVTDTNYNILKFNGKALWGIRLFDSANTAASTRVFRSGRRRIDRTTWRLKMLQELFAEEIAKVDSGFFMRLEDSRLQLDDKREKAVYNLFVDKNYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTIKQKAMQSLLPAQTKQQKAIIQLFSGGKAKLAELFLDEELDECEKKSVSFQDDDLDELEPVLTAALGERYEGLLRFKAIYDWSLLAKILHLDAEKKDDSEQHLLSECKVQVYEEHKRDLTVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGNRLVFYGAGQLCISENETVYLKRALKYRDSIEENENIITAKDTDDKQKEKAQKRLDFYKQTWGISREANMRIYDILLAKSGNNLYKNRPASQTKDLQEQRGTFEKLPLSKQIYVIGEFLNLFKCASTSADFKLLGKGNSCGVIKTTNNVTKCKQCVLINQSPTGVFEQEVDLMKL

SEQ ID NO: 1377 - protein, 1379 aa, Unknown; identical to SEQ ID NO: 1361
  Description of Unknown: uncultivated organism with predicted taxonomy: Phascolarctobacterium succinatutens
  MG18-25 effector

SEQ ID NO: 1378 - protein, 1379 aa, Unknown; identical to SEQ ID NO: 1361
  Description of Unknown: uncultivated organism with predicted taxonomy: Phascolarctobacterium succinatutens
  MG18-26 effector

SEQ ID NO: 1379 - protein, 1379 aa, Unknown
  Description of Unknown: uncultivated organism with predicted taxonomy: Phascolarctobacterium succinatutens
  MG18-27 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSLEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1380 - protein, 1379 aa, Unknown
  Description of Unknown: uncultivated organism with predicted taxonomy: Phascolarctobacterium
  MG18-28 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVVTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSNIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1381 - protein, 1379 aa, Unknown
  Description of Unknown: uncultivated organism with predicted taxonomy: Phascolarctobacterium succinatutens
  MG18-29 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1382 - protein, 1148 aa, Unknown
  Description of Unknown: uncultivated organism with predicted taxonomy: Phascolarctobacterium succinatutens
  MG18-30 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKVVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKMEQFSYL

SEQ ID NO: 1383 - protein, 1148 aa, Unknown; identical to SEQ ID NO: 1382
  Description of Unknown: uncultivated organism with predicted taxonomy: Phascolarctobacterium succinatutens
  MG18-31 effector

SEQ ID NO: 1384 - protein, 1379 aa, Unknown
  Description of Unknown: uncultivated organism with predicted taxonomy: Phascolarctobacterium succinatutens
  MG18-32 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVYDFNAVFSEVENYVRDEMGIEDWSCQNIDELAKVLYDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGHEPKRIFIEMARSKEESKRTDSRLKKLQDLYKQCREENIDFMPRKDEFNTLKTQLSSKKEDDLRIDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVAEYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGTSCGVIKTSNNITKCEQCILINQSPTGVFEQEVDLMKL

SEQ ID NO: 1385 - protein, 1379 aa, Unknown; identical to SEQ ID NO: 1361
  Description of Unknown: uncultivated organism with predicted taxonomy: Phascolarctobacterium succinatutens
  MG18-33 effector

SEQ ID NO: 1386 - protein, 1379 aa, Unknown; identical to SEQ ID NO: 1361
  Description of Unknown: uncultivated organism with predicted taxonomy: Phascolarctobacterium succinatutens
  MG18-34 effector

SEQ ID NO: 1387 - protein, 1379 aa, Unknown; identical to SEQ ID NO: 1364
  Description of Unknown: uncultivated organism with predicted taxonomy: Phascolarctobacterium succinatutens
  MG18-35 effector

SEQ ID NO: 1388 - protein, 1379 aa, Unknown; identical to SEQ ID NO: 1361
  Description of Unknown: uncultivated organism with predicted taxonomy: Phascolarctobacterium succinatutens
  MG18-36 effector

SEQ ID NO: 1389 - protein, 1379 aa, Unknown
  Description of Unknown: uncultivated organism with predicted taxonomy: Phascolarctobacterium succinatutens
  MG18-37 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIGFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKEKAQKGLDFYEQKWGISGAVNVQLYDMFIAKSANNLYKNRPVSQTITLKEKREHFVKLTVSKQIHIIKEILNLFKCASASDDFKLIDKGTSCGTLKISNNINKLKECILINQSPTGVFEQEVDLMKL

SEQ ID NO: 1390 - protein, 1379 aa, Unknown
  Description of Unknown: uncultivated organism with predicted taxonomy: Phascolarctobacterium
  MG18-38 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEKAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1391 - protein, 1379 aa, Unknown
  Description of Unknown: uncultivated organism with predicted taxonomy: Phascolarctobacterium
  MG18-39 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1392 - protein, 1379 aa, Unknown
  Description of Unknown: uncultivated organism with predicted taxonomy: Phascolarctobacterium succinatutens
  MG18-40 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVVSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQPLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVKDYLTEVVQLCKPEIKIPKIKKYSLFKINGFPMHISGRQGKQLIFYVAGQLCINEDSIAYLKKVFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1393 - protein, 1291 aa, Unknown
  Description of Unknown: uncultivated organism with predicted taxonomy: Phascolarctobacterium succinatutens
  MG18-41 effector
MQKLQNKDYYIGLDMGDASVGWAVTDANYNILKFNGKALWGIRLFDSANTAASTRVFRSGRRRIDRTTWRLKMLQELFADEIAKVDPGFFMRLEDSRLHLDDKRENAVYNLFVDKNYTDKEFHQQYPTMYHLRYALATKKGPFDIRLLYLAVQHIAKHRGHFLFDNLDASTVNDFNAVFSEVENYVHDEMGLEDWSCQNKDALAKVLCDVNLGRTTKQKAMQSLLPAKSKQQKAILQLFSGGKAKLAELFDDEELDDCEKKSISFQDDDLDEIEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLSFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKIQLNSKKDYDLRSDKLYLYYTQMGRCMYTGERIELASLYDDNLYDIDHIYPRSKTKDDSLSNRVLVKKEVNAAKTDIYPLDAAIRTKMHSFWKLLYDKGLIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTAHPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKI

SEQ ID NO: 1394 - protein, 1379 aa, Unknown; identical to SEQ ID NO: 1355
  Description of Unknown: uncultivated organism with predicted taxonomy: Phascolarctobacterium succinatutens
  MG18-42 effector

SEQ ID NO: 1395 - protein, 1379 aa, Unknown; identical to SEQ ID NO: 1364
  Description of Unknown: uncultivated organism with predicted taxonomy: Phascolarctobacterium succinatutens
  MG18-43 effector

SEQ ID NO: 1396 - protein, 1379 aa, Unknown
  Description of Unknown: uncultivated organism with predicted taxonomy: Phascolarctobacterium succinatutens
  MG18-44 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDEFAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAALKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERLFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCYYDFIGKIKEFNGSRQSSNGKLTYKDVEELYVSPSVKRSVWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSMQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1397 - protein, 1379 aa, Unknown
  Description of Unknown: uncultivated organism with predicted taxonomy: Phascolarctobacterium succinatutens
  MG18-45 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1398 - protein, 1158 aa, Unknown
  Description of Unknown: uncultivated organism with predicted taxonomy: Phascolarctobacterium
  MG18-46 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPADVLEKIFKQLFLEKTSKVTKKTLERFFRQENISFQNIGGIDDKINASMKSYNDFKRIFGEDYIQLHREEIENIIRWITLFCDEKKMLVTKIKNTYTQISDDEIKAIKKLKYKDWGRLSATLLNSRAIGYEDKAVGEIITIISALRHTNKNLMELLSNYCPYDFIGEIKDFNGSRQSSNGKLTYKDVEELYVSPSVKRSIWQTLTILEEIKKIMGCESKRIFIEMARSKEESKRTDSRLKKLQDLYKKCKEENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANHLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAK

SEQ ID NO: 1399 - protein, 1383 aa, Unknown; identical to SEQ ID NO: 1359
  Description of Unknown: uncultivated organism with predicted taxonomy: Phascolarctobacterium
  MG18-47 effector

SEQ ID NO: 1400 - protein, 1379 aa, Unknown
  Description of Unknown: uncultivated organism with predicted taxonomy: Phascolarctobacterium succinatutens
  MG18-48 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLDDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1401 - protein, 1379 aa, Unknown
  Description of Unknown: uncultivated organism with predicted taxonomy: Phascolarctobacterium succinatutens
  MG18-49 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEHREFFEKLSLANQIHVIGEVLKLFKCASASANLKLLDKGNACGVIKVSNNILKFKQCVLINQSPTGVFEQEVDLMKL

SEQ ID NO: 1402 - protein, 1379 aa, Unknown; identical to SEQ ID NO: 1361
  Description of Unknown: uncultivated organism with predicted taxonomy: Phascolarctobacterium succinatutens
  MG18-50 effector

SEQ ID NO: 1403 - protein, 1275 aa, Unknown
  Description of Unknown: uncultivated organism with predicted taxonomy: Phascolarctobacterium succinatutens
  MG18-51 effector
MHKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSSQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLDDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIILPKIKKYSLFKINGFPMHISGRQLKQLQFYVASQLCIDEYSIAYLKKAFKYENNLAVNDEIIADKNADEEKKQKARKRLDFYEKTWGIGKENNMR

SEQ ID NO: 1404 - protein, 1379 aa, Unknown
  Description of Unknown: uncultivated organism with predicted taxonomy: Phascolarctobacterium succinatutens
  MG18-52 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWKFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1405 - protein, 1379 aa, Unknown
  Description of Unknown: uncultivated organism with predicted taxonomy: Firmicutes
  MG18-53 effector
MQKLQNKDYYIGLDMGDASVGWAVTDANYNILKVNGKALWGIRLFDSANTAASTRVFRSGRRRIDRTTWRLKMLQELFADEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKVFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRNTQLGDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLLKINGFPMHISGKTVKQIIFYAAGQLCLADDVADYLKKALKYEVYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1406 - protein, 1379 aa, Unknown
  Description of Unknown: uncultivated organism with predicted taxonomy: Phascolarctobacterium
  MG18-54 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLQLDDKREKAVYNLFVDKNYTDKEFYQQYPTMYHLRYALATQKGHFDVRLLYLAVQHIAKHRGHFLFDNLDASKVNDFNAVFSEVENYVRDEMGIEDWSCQNVDELAKVLCDVNLGRTIKQKAMQSLLPAQTKQQKAIIQLFSGGKAKLAELFLDEELDECEKKSVSFQDDDLDELEPVLTAALGERYEGLLRFKAIYDWNLLAKILHLDAEKKDDSEQHLLSECKVQVYEEHKRDLTVLKSMLKGKPLYNKIFRQDGDISYEKYAKGIKGRNQIDFCKDLKKQLEGIAEYKKIMQEITSIDDAKTEEERLLFRIANGFAFPKQTTKDNGIIPIQVHLAELKCILDNAESYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDNKINASMKSYNDFRRIFGEDYIQLHRDEIENIIRWITLFCDEKKMLATKIRNTYPQISDDKIKAIKKLKYKDWGRLSATLLNSSAIAYEDKGFGELVTIISALRHTNKNFMELLSSYCSYDFIGKIKEYNSGRQNSNSKLTYKDVEELYVSPSVKRSIWQTLTILEEIKKITGHEPKRIFIEMARSKEESKRTDSRLKKLQDLYKQCKEENIDFMPHTDELNAFKIQLSSKKEDDLRSDKLYLYYTQMGRCMYTGERIEIASLYDDNLYDIDHIYPRSKTKDDSLSNRVLVKKEVNAAKTDIYPLDAAIRTKMHTFWKLLYDKGFIDERKYERLIRSKQLRDEELAGFISRQLVETRQSTKAVATILKTAYKHSEIVYVKAGNVSDFRQKFEFVKCRDVNDLHHAKNAYLNIVVGNCYYVKFTAKPLDFIKKNQDNRSYSLKPEIFYKFSIKRDSEIAWVGGKDGTITTVTKTIHKNNILFTRQPVEGKGELFKQNPLKANSGQLPLKAGLSVEKYGGYDSLTTAYFALVKSEGKKGAVQLSIEAIPLVYAKQGENAVQKYLTDVVQLCKPEIKIPKIKKYSLFKINGFPMHIYGRTGNRLVFYGAGQLCISENETVYLKRALKYRDSIEKNENIITAKDTDDKQKEKAQKRLDFYKQTWGISREANMRIYDILLAKSGNNLYKNRPASQTKDLQEQRGTFEKLPLSKQIYVIGEFLNLFKCASTSADFKLLGKGNSCGVIKTTNNVTKCKQCVLINQSPTGVFEQEVDLMKL

SEQ ID NO: 1407 - protein, 1379 aa, Unknown
  Description of Unknown: uncultivated organism with predicted taxonomy: Phascolarctobacterium
  MG18-55 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKMMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISSVKQCILINQSPTGIFEQEVDLMKL

SEQ ID NO: 1408 - protein, 1379 aa, Unknown
  Description of Unknown: uncultivated organism with predicted taxonomy: Phascolarctobacterium succinatutens
  MG18-56 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1409 - protein, 1379 aa, Unknown
  Description of Unknown: uncultivated organism with predicted taxonomy: Phascolarctobacterium succinatutens
  MG18-57 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQTGPIDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEEHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEDSAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKDVEELYVSPSVKRSIWQTLTILEEIKKIMGCEPKRIFIEMARSKEESKRTDSRLKKLHDLYKKCREENIDFMPRKDEFNALKTQLSSKKEENLRSDKLYLYYTQMGRCMYTGERIELASLHDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1410 - protein, 1379 aa, Unknown
  Description of Unknown: uncultivated organism with predicted taxonomy: Phascolarctobacterium succinatutens
  MG18-58 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFFFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLHDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCHHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1411 - protein, 1379 aa, Unknown; identical to SEQ ID NO: 1405
  Description of Unknown: uncultivated organism with predicted taxonomy: Phascolarctobacterium succinatutens
  MG18-59 effector

SEQ ID NO: 1412 - protein, 1345 aa, Unknown
  Description of Unknown: uncultivated organism
  MG18-60 effector
NGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1413 - protein, 1259 aa, Unknown
  Description of Unknown: uncultivated organism with predicted taxonomy: Phascolarctobacterium succinatutens
  MG18-61 effector
MLQELFAEEIAKVDPGFFMPLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEKIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCRELNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASA

SEQ ID NO: 1414 - protein, 1379 aa, Unknown
  Description of Unknown: uncultivated organism with predicted taxonomy: Phascolarctobacterium succinatutens
  MG18-62 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGTQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1415 - protein, 1379 aa, Unknown
  Description of Unknown: uncultivated organism
  MG18-63 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLCNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKPTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1416 - protein, 1379 aa, Unknown
  Description of Unknown: uncultivated organism with predicted taxonomy: Phascolarctobacterium succinatutens
  MG18-64 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLQLDDKREKAVYNLFVDKSYTDKEFYQQYPTMYHLRYALATQKGPFDVRLFYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLDEIEPVLTAALGERYEGLLRFKAIYDWSLLAKILHLDAEKKDDSEQHLLSECKVQVYEEHKRDLAVLKSMLKGKPLYNKIFRQDGDISYEKYAKGIKGCNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQYLYKKCREENIDFMPRKDEFNALKTQLSSKKEEDLRSDKLYLYYTQMGRCMYTGESIELASLYDNNLYDIDHIYPRSKTKDDSLSNRVLVQKQVNAAKTDIYPLDAAIRTKMHSFWNLLYDKGFIDERKYERLMRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1417 - protein, 1379 aa, Unknown
  Description of Unknown: uncultivated organism with predicted taxonomy: Firmicutes
  MG18-65 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQPLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVKDYLTEVVQLCKPEIKIPKIKKYSLFKINGFPMHISGRQGKQLIFYVAGQLCINEDSIAYLKKVFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1418 - protein, 1379 aa, Unknown
  Description of Unknown: uncultivated organism with predicted taxonomy: Phascolarctobacterium succinatutens
  MG18-66 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLCNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYSQISDDEIKAIKKLKYKDWGRLSATLLNSSTIAYEDKAFGELVTIISALRHTNKNFMELLSSYCYYDFIGKIKEFNGSRQSSNGKPTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1419 - protein, 1379 aa, Unknown
  Description of Unknown: uncultivated organism
  MG18-67 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKNLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTFLEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKIAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1420 - protein, 1379 aa, Unknown
  Description of Unknown: uncultivated organism with predicted taxonomy: Phascolarctobacterium succinatutens
  MG18-68 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKEVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYTKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1421 - protein, 1379 aa, Unknown
  Description of Unknown: uncultivated organism with predicted taxonomy: Phascolarctobacterium succinatutens
  MG18-69 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVSIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1422 - protein, 1379 aa, Unknown; identical to SEQ ID NO: 1360
  Description of Unknown: uncultivated organism with predicted taxonomy: Negativicutes
  MG18-70 effector

SEQ ID NO: 1423 - protein, 1379 aa, Unknown
  Description of Unknown: uncultivated organism with predicted taxonomy: Phascolarctobacterium succinatutens
  MG18-71 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKEVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1424 - protein, 1379 aa, Unknown
  Description of Unknown: uncultivated organism with predicted taxonomy: Phascolarctobacterium succinatutens
  MG18-72 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1425 - protein, 1379 aa, Unknown
  Description of Unknown: uncultivated organism with predicted taxonomy: Phascolarctobacterium
  MG18-73 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLDDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1426 - protein, 1379 aa, Unknown
  Description of Unknown: uncultivated organism with predicted taxonomy: Phascolarctobacterium succinatutens
  MG18-74 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGITEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1427 - protein, 1379 aa, Unknown; identical to SEQ ID NO: 1358
  Description of Unknown: uncultivated organism with predicted taxonomy: Phascolarctobacterium
  MG18-75 effector

SEQ ID NO: 1428 - protein, 1124 aa, Unknown
  Description of Unknown: uncultivated organism with predicted taxonomy: Phascolarctobacterium succinatutens
  MG18-76 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRKQFKFVKCRDVNDLHHAKDAYLNIVVGNCYHVKFTANPLNFITKNQDNRRYSLKPEIFYKFSIKRDGEIAWIGGKDGTITTVTKTMHKNNILFTRQPVEGKGELFKQQPLKAKSGQLPLKAGLSVEKYGG

SEQ ID NO: 1429 - protein, 811 aa, Unknown
  Description of Unknown: uncultivated organism with predicted taxonomy: Clostridiales
  MG18-77 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQGRKY

SEQ ID NO: 1430 - protein, 1379 aa, Unknown; identical to SEQ ID NO: 1397
  Description of Unknown: uncultivated organism with predicted taxonomy: Phascolarctobacterium
  MG18-78 effector

SEQ ID NO: 1431 - protein, 1379 aa, Unknown
  Description of Unknown: uncultivated organism with predicted taxonomy: Phascolarctobacterium succinatutens
  MG18-79 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWKFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKRREENIDFMPRKDEFNALKTQLSSKKEENLRSDKLYLYYTQMGRCMYTGERIELASLHDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKRGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1432 - protein, 1379 aa, Unknown; identical to SEQ ID NO: 1375
  Description of Unknown: uncultivated organism with predicted taxonomy: Phascolarctobacterium succinatutens
  MG18-80 effector

SEQ ID NO: 1433 - protein, 1383 aa, Unknown
  Description of Unknown: uncultivated organism with predicted taxonomy: Phascolarctobacterium succinatutens
  MG18-81 effector
MQNKKNVDYYVGLDMGDASVGWAVTDLNYNILKFNGKALWGIRLFDSAETAAARRGFRSARRRIDRVSWRISMLQELFADEIAKVDAGFFQRLKDSRLQVEDKQEKTAYNLFVGQNYTDKDFYQQYPTMYHLRYALATQAGPFDVRLLYLAVQHIVKHRGHFLFENLDASKVGDFVAVFGEVESYVHDEMELDEWYCHDIDALAKVLCNANLGITAKQKAIQNLLPAKTKQEKAIVQLLSGGKAKLCDLFCDEELAECEKKSISFQEDNLDELEPILEAILQERYEALLRFKAVYDWSLLAKILRLDADKKSENEMHLLSECKVKVYEEHKKDLAVLKSMLKGKPLYNKLFRQDGEDTYANYAQGIKGINQVDFCKSLKKQLESIGEYKKQMQQLTSFEDAQTDVERLLFRVANGLAFPKQTTKDNGIIPIQVHLAELQCILAHAEKYLPFLKNADANGLSVREKITQIVKFRIPYYVGPLAGTRLSREQGRCWVERRAELKNEKIYPWNFDKVVDLEASAENFITNMTAKCTYLVGEDVLPKESLLYSEFMVRNALNNLTIDGERLPVSLLQKIYKQLFLEKTFKVTKKALERFFKQENVSYHDIGGIDDKINASMKAYNDFKRIFGEAYIEMHRDEIENIIRWITLFCDEKKMLETKIRKTYPQIPDDKIKAIKKLKYKDWGRLSATLLDSGKIAYEDASVGERITIISALRHTNKNFMELLSSNCQYDFIGKIKDFNGSKQSDNGKLTYKDVEELYVSPSVKRSIWQTLTILEEIKKIMGCEPKRIFIEMARSKEESLRTNSRLQRLQDLYKKCKEENIDFMPKADELTDIRSQLQCKNEEDLRSDKLYLYYTQMGRCMYTGERIELASLYDQNKYDVDHIYPRSKTKDDSLNNRVLVKKEINSAKTDNYPIDADIRKKMHAFWKMLYDKGFIDQKKYERLTRSTQLTDEELAGFINRQLVETRQSTKATADILKSAYEHSEVVYVKAGNVSDFRQQFDFVKCREVNDLHHAKDAYLNIVVGNCYHVKFTINPLMFIRGNQDNRRYSLKPEVFYAHDIKRNGEIAWLAGDNGTMATVKRVMQKNNVLFTRLAVEGKGELFKQNPLKAKSGQLPLKAGLSIDKYGGYDSLSTAYFALVESEGKKGAVQFTIEAIPLVYAKQGEATIKKYLTEVVQLCKPEIKVMRIKKYSLLKINGFPMHISGRTGKQLIFYVASQLCIDENSVAYLKKALKYESNLEENEAILADKNADESMKQKAFNRLMFYKDTWGISAEANLQLYDMLLAKSANNLYKNRPASQTATLKEKREQFAKLSLSKQIHVIKEILNLFKCASASADFKLLDKGAACGILKVSNNITKLKQCVLINQSPTGVFEQEVDLMRL

SEQ ID NO: 1434 - protein, 1379 aa, Unknown
  Description of Unknown: uncultivated organism with predicted taxonomy: Phascolarctobacterium succinatutens
  MG18-82 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELSVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQVGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLNDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1435 - protein, 1379 aa, Unknown
  Description of Unknown: uncultivated organism with predicted taxonomy: Phascolarctobacterium succinatutens
  MG18-83 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEKERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVFPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLIKL

SEQ ID NO: 1436 - protein, 1379 aa, Unknown
  Description of Unknown: uncultivated organism with predicted taxonomy: Phascolarctobacterium succinatutens
  MG18-84 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRIDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1437 - protein, 1379 aa, Unknown
  Description of Unknown: uncultivated organism with predicted taxonomy: Phascolarctobacterium
  MG18-85 effector
MQKLQNKDYYIGLDMGDASVGWAVTDANYNILKFNGKALWGIRLFDSANTAASTRVFRSGRRRIDRTTWRLKMLQELFADEIAKVDPGFFMRLEDSRLHLDDKRENAVYNLFVDKNYTDKEFHQQYPTMYHLRYALATKKGPFDIRLLYLAVQHIAKHRGHFLFDNLDASTVNDFNAVFSEVENYVHDEMGLEDWSCQNKDALAKVLCDVNLGRTTKQKAMQSLLPAKSKQQKAILQLFSGGKAKLAELFDDEELDDCEKKSISFQDDDLDEIEPVLTAALGERYEGLLRFKAIYDWSLLAKILHLDTGKKEEGEQHLLSECKVQVYEEHKRDLAVLKSMLRGNFLYNKIFRQDGDISYEKYAKGIKGRNQFDFCKDLKKQLECIAEYKKIMQEITSIDAAGTEEERLLFRIANGFAFPKQTTKDNGIIPIQVHLAELKCILDNAEGYLPFLGETDNNSLSVREKIEQIVKFRIPYYVGPLAGTRMSREQGRCWVVRKNEKIYPWNFTEIVNLEESAEKFITNMTAKCTYLFGEDVLPKESLLYSEFMVRNAINNITVDGERLPFDVLEKIFKQLFLAKTSKVTKKTLARFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLAIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKKLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1438 - protein, 1379 aa, Unknown; identical to SEQ ID NO: 1361
  Description of Unknown: uncultivated organism with predicted taxonomy: Phascolarctobacterium succinatutens
  MG18-86 effector

SEQ ID NO: 1439 - protein, 1379 aa, Unknown
  Description of Unknown: uncultivated organism with predicted taxonomy: Phascolarctobacterium succinatutens
  MG18-87 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNSEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1440 - protein, 1379 aa, Unknown; identical to SEQ ID NO: 1358
  Description of Unknown: uncultivated organism with predicted taxonomy: Phascolarctobacterium
  MG18-88 effector

SEQ ID NO: 1441 - protein, 1379 aa, Unknown
  Description of Unknown: uncultivated organism with predicted taxonomy: Firmicutes
  MG18-89 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSRYCSYDFIGKIKEFNGRRQSSNGKLTYKDVEELYVSPSVKRSIWQTLTILEEIKKIMGCEPKRIFIEMARSKEESKRTDSRLKKLQDLYKKCREENIDFMPRKDEFNVLKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMETVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1442 - protein, 1379 aa, Unknown
  Description of Unknown: uncultivated organism with predicted taxonomy: Phascolarctobacterium
  MG18-90 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKMMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1443 - protein, 1379 aa, Unknown
  Description of Unknown: uncultivated organism with predicted taxonomy: Phascolarctobacterium succinatutens
  MG18-91 effector
MQKLKNCDYYIGLDMGDASVGWAVTDTNYNILKFNGKALWGIRLFDSANTAASTRVFRSGRRRIDRTTWHLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKEVEDLYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGADGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1444 - protein, 1379 aa, Unknown
  Description of Unknown: uncultivated organism with predicted taxonomy: Phascolarctobacterium succinatutens
  MG18-92 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1445 - protein, 1379 aa, Unknown
  Description of Unknown: uncultivated organism
  MG18-93 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLNDNNLYDIDHIYPRSKTKDDSLSNRVLVKKQVNAAKTDTYPLDAAIRIKMHSFWKLLYDKGFIDERKYERLTRSTQLRDEELAGFISRQLVEMRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1446 - protein, 1379 aa, Unknown; identical to SEQ ID NO: 1423
  Description of Unknown: uncultivated organism with predicted taxonomy: Phascolarctobacterium succinatutens
  MG18-94 effector

SEQ ID NO: 1447 - protein, 1363 aa, Unknown
  Description of Unknown: uncultivated organism
  MG18-95 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKEVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVKDYLTEVVQLCKPEIKIPKIKKYSLFKINGFPMHISGRQGKQLIFYVAGQLCINEDSIAYLKKVFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNILQVFLNRKWI

SEQ ID NO: 1448 - protein, 1222 aa, Unknown
  Description of Unknown: uncultivated organism with predicted taxonomy: Clostridium sp. CAG:964
  MG18-96 effector
RTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNN

SEQ ID NO: 1449 - protein, 1379 aa, Unknown; identical to SEQ ID NO: 1397
  Description of Unknown: uncultivated organism with predicted taxonomy: Phascolarctobacterium succinatutens
  MG18-97 effector

SEQ ID NO: 1450 - protein, 1379 aa, Unknown
  Description of Unknown: uncultivated organism with predicted taxonomy: Phascolarctobacterium succinatutens
  MG18-98 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKVFYQQYPTMYHLRYALATQAGPFDVRLLYLAVQHIAKHRGHFLFDNLDASKVNNFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKEVEDLYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEFFYKFNIKRDDDIAWLGGADGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1451 - protein, 1379 aa, Unknown; identical to SEQ ID NO: 1357
  Description of Unknown: uncultivated organism with predicted taxonomy: Firmicutes
  MG18-99 effector

SEQ ID NO: 1452 - protein, 1379 aa, Unknown
  Description of Unknown: uncultivated organism with predicted taxonomy: Phascolarctobacterium succinatutens
  MG18-100 effector
MHKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIHKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1453 - protein, 1379 aa, Unknown
  Description of Unknown: uncultivated organism with predicted taxonomy: Firmicutes
  MG18-101 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKIYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPADVLEKIFKQLFLEKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGCCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVAEYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCEKCILINQSPTGVFEQEVDLMKL

SEQ ID NO: 1454 - protein, 1378 aa, Unknown
  Description of Unknown: uncultivated organism with predicted taxonomy: Firmicutes
  MG18-102 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPVQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGHESKRIFIEMARSKEESKRTDSRLKKLQDLYKKCREENIDFMPRKDEFNALKTQLSSKKEDDLRSDKLYLYYTQMGRCMYTGESIELASLYDNNLYDIDHIYPRSKTKDDSLSNRVLVKKQVNAAKTDIYPLDAAIRTKMHSFWKLLYDKGFIDERKYERLMRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1455 - protein, 1379 aa, Unknown
  Description of Unknown: uncultivated organism with predicted taxonomy: Phascolarctobacterium succinatutens
  MG18-103 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGCTTKQKAMQSLLPVQTKQQKAIIQLFSGSKAKLAELFGDAELDECEKKSVSFQDDDLNEFEPVLTAALGERYEGLLRFKAIYDWSLLAKILHLDAGKKDEGEQHLLSECKVQVYEEHKRDLAVLKSMLKGKPLYNKIFRQDGDISYEKYAKGIKGRNQLDFCKDLKKQLEGITEYKKIMQAITSIDDAKTDEERLLFRIANGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLHDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1456 - protein, 1379 aa, Unknown
  Description of Unknown: uncultivated organism with predicted taxonomy: Phascolarctobacterium
  MG18-104 effector
MQKLKNCDYYIGLDMGDASVGWAVTDTNYNILKFNGKALWGIRLFDSANTAASTRVFRSGRRRIDRTTWRLKMLQELFADEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKNALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1457 - protein, 1379 aa, Unknown; identical to SEQ ID NO: 1452
  Description of Unknown: uncultivated organism with predicted taxonomy: Phascolarctobacterium succinatutens
  MG18-105 effector

SEQ ID NO: 1458 - protein, 1379 aa, Unknown; identical to SEQ ID NO: 1361
  Description of Unknown: uncultivated organism with predicted taxonomy: Firmicutes
  MG18-106 effector

SEQ ID NO: 1459 - protein, 1379 aa, Unknown
  Description of Unknown: uncultivated organism with predicted taxonomy: Phascolarctobacterium succinatutens
  MG18-107 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNAFKTQLSSKKEEDLRSDKLYLYYTQMGRCMYTGERIELASLHDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSAVVYVKAGNVSDFRQQFKFVKCREVNDLHHAKDAYLNIVVGNCYHVKFTASPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEHEVDLMKL

SEQ ID NO: 1460 - protein, 1379 aa, Unknown
  Description of Unknown: uncultivated organism with predicted taxonomy: Ruminococcaceae bacterium
  MG18-108 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVAEYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCEQCILINQSPTGVFEQEVDLMKL

SEQ ID NO: 1461 - protein, 1379 aa, Unknown
  Description of Unknown: uncultivated organism with predicted taxonomy: Phascolarctobacterium succinatutens
  MG18-109 effector
MQKLKNCDYYIGLDMGDASVGWAVTDTNYNILKFNGKALWGIRLFDSANTAASTRVFRSGRRRIDRTTWHLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELVGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1462 - protein, 879 aa, Unknown
  Description of Unknown: uncultivated organism with predicted taxonomy: Clostridiales bacterium
  MG18-110 effector
MQKLKNCDYYIGLDMGDASVGWAVTDTNYNILKFNGKALWGIRLFDSANTTASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERLSLIHISEPTRPLYIS

SEQ ID NO: 1463 - protein, 1379 aa, Unknown; identical to SEQ ID NO: 1357
  Description of Unknown: uncultivated organism with predicted taxonomy: Phascolarctobacterium succinatutens
  MG18-111 effector

SEQ ID NO: 1464 - protein, 1379 aa, Unknown
  Description of Unknown: uncultivated organism with predicted taxonomy: Phascolarctobacterium succinatutens
  MG18-112 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWVRLSATLLNSSAIAYDDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1465 - protein, 1379 aa, Unknown
  Description of Unknown: uncultivated organism with predicted taxonomy: Clostridiales
  MG18-113 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLHLDDKRDKAVYNLFVDKNYTDKDFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIGQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFIPLKDEFNALKTQLSSKKEEDLRSDKLYLYYTQMGCCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLIFYGAGQLCIADDVADYLKKALKYETDIAEKEKTLADQNADEIQKQKAQKGLDFCEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1466 - protein, 1379 aa, Unknown
  Description of Unknown: uncultivated organism with predicted taxonomy: Phascolarctobacterium
  MG18-114 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQNAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFEQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLAYKDVEELYVSPSGKRSIWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLNDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYQNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1467 - protein, 1379 aa, Unknown
  Description of Unknown: uncultivated organism with predicted taxonomy: Phascolarctobacterium succinatutens
  MG18-115 effector
MHKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSSQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLDDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1468 - protein, 1379 aa, Unknown
  Description of Unknown: uncultivated organism with predicted taxonomy: Phascolarctobacterium succinatutens
  MG18-116 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFNIKRDDDIAWLGGEDGTMATVARTMHKNNILFTRQAVEGKGELFKQNPLKANSGQLPLKAGLSVEKYGGYDSLTTAYFAVVKSEGKKGAVQLSIEGIPLVYARQGEDAIKKYLIEVVHLCNPIIKLNKIKKYSLFKINGFPMHISGRQGKQLIFYVAGQLCLDEESIAYLKKAFKYESDLAINEEIIDDKNAAEENKQKAHKRLDFYENTWGISEVANMQLYDILIAKSANNLYKNRPASQTSTLKQQRDMFAKLPLSKQIRVIKEAMNLFKCASATADFKLLGKGSVCGKIQVSTNITKCKQCILINQSPTGVFEQEVDLMKL

SEQ ID NO: 1469 - protein, 1379 aa, Unknown; identical to SEQ ID NO: 1397
  Description of Unknown: uncultivated organism with predicted taxonomy: Phascolarctobacterium
  MG18-117 effector

SEQ ID NO: 1470 - protein, 1379 aa, Unknown
  Description of Unknown: uncultivated organism with predicted taxonomy: Phascolarctobacterium succinatutens
  MG18-118 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKILYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1471 - protein, 1379 aa, Unknown; identical to SEQ ID NO: 1420
  Description of Unknown: uncultivated organism with predicted taxonomy: Phascolarctobacterium succinatutens
  MG18-119 effector

SEQ ID NO: 1472 - protein, 1379 aa, Unknown; identical to SEQ ID NO: 1421
  Description of Unknown: uncultivated organism with predicted taxonomy: Phascolarctobacterium succinatutens
  MG18-120 effector

SEQ ID NO: 1473 - protein, 1379 aa, Unknown; identical to SEQ ID NO: 1425
  Description of Unknown: uncultivated organism with predicted taxonomy: Phascolarctobacterium succinatutens
  MG18-121 effector

SEQ ID NO: 1474 - protein, 1379 aa, Unknown
  Description of Unknown: uncultivated organism with predicted taxonomy: Phascolarctobacterium
  MG18-122 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMHRKDEFNALKTQLSSKKEEDLRSDKLYLYYTQMGRCMYTGERIELASLYDNNLYDIDHIYPRSKTKDDSLSNRVLVKKQVNAAKTDIYPLDAAISTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1475 - protein, 1379 aa, Unknown
  Description of Unknown: uncultivated organism with predicted taxonomy: Phascolarctobacterium succinatutens
  MG18-123 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETDIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1476 - protein, 1379 aa, Unknown
  Description of Unknown: uncultivated organism with predicted taxonomy: Phascolarctobacterium succinatutens
  MG18-124 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLQLDDKREKAAYNLFVDKSYTDKEFYQQYPTMYHLRYALATQKGPFDVRLLYLAVQHIAKHRGHFLFDNLDASKVNDFNAVFSEVENYVRDEMGIEDWSCQNIDEFAKVLRDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILENAEGYLPFLGETDNNGLSVREKIKQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMVRSKEESKRTDSRLKKLQDLYKKCREENIDFMPRKDEFNALKTMLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1477 - protein, 1379 aa, Unknown; identical to SEQ ID NO: 1391
  Description of Unknown: uncultivated organism with predicted taxonomy: Phascolarctobacterium
  MG18-125 effector

SEQ ID NO: 1478 - protein, 1379 aa, Unknown
  Description of Unknown: uncultivated organism with predicted taxonomy: Phascolarctobacterium
  MG18-126 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLHLDDKRDKAVYNLFVDKNYTDKDFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFIPLKDEFNALKTQLSSKKEEDLRSDKLYLYYTQMGCCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLIFYGAGQLCIADDVADYLKKALKYETDIAEKEKTLADQNADEIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1479 - protein, 1379 aa, Unknown; identical to SEQ ID NO: 1436
  Description of Unknown: uncultivated organism with predicted taxonomy: Phascolarctobacterium
  MG18-127 effector

SEQ ID NO: 1480 - protein, 1379 aa, Unknown
  Description of Unknown: uncultivated organism with predicted taxonomy: Phascolarctobacterium
  MG18-128 effector
MQKLKNCDYYIGLDMGDASVGWAVTDTNYNILKFNGKALWGIRLFDSANTAASTRVFRSGRRRIDRTTWHLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGHEPKRIFIEMARSKEESKRTDSRLKKLQDLYKQCREENIDFMPHTDELNAFKIQLSSKKEDDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1481 - protein, 1379 aa, Unknown
  Description of Unknown: uncultivated organism with predicted taxonomy: Phascolarctobacterium succinatutens
  MG18-129 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERNEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGITEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLAYKDVEELYVSPSVKRSIWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1482 - protein, 1379 aa, Unknown
  Description of Unknown: uncultivated organism with predicted taxonomy: Phascolarctobacterium succinatutens
  MG18-130 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRRDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1483 - protein, 1379 aa, Unknown
  Description of Unknown: uncultivated organism with predicted taxonomy: Phascolarctobacterium succinatutens
  MG18-131 effector
MQKLKNCDYYIGLDMGDASVGWAVTDTNYNILKFNGKALWGIRLFDSANTAASTRVFRSGRRRIDRTTWRLKMLQELFAEEIAKVDTGFFMRLEDSRLQLDDKREKAVYNLFVDKSYTDKEFYQQYPTMYHLRYALATQAGPFDVRLLYLAVQHIAKHRGHFLFDNLDASKVNNFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKNLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKEVEDLYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1484 - protein, 1379 aa, Unknown
  Description of Unknown: uncultivated organism with predicted taxonomy: Phascolarctobacterium succinatutens
  MG18-132 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGTVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1485 - protein, 1235 aa, Unknown
  Description of Unknown: uncultivated organism with predicted taxonomy: Phascolarctobacterium succinatutens
  MG18-133 effector
VRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTISYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMHRKDEFNALKTQLSSKKEEDLRSDKLYLYYTQMGRCMYTGERIELASLYDNNLYDIDHIYPRSKTKDDSLSNRVLVKKQVNAAKTDIYPLDAAISTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1486 - protein, 1348 aa, Unknown
  Description of Unknown: uncultivated organism with predicted taxonomy: Clostridiales
  MG18-135 effector
MDQNKEYYIGLDGGTDSVGWAVLNPDYTVVKKRGKSLWGVRLFESGQTAAERRLARSARRRTDRRKWRLKLLKELFAEEVAACDPAFFARLAESRYWEDDKKVDGADTLFHDADFTDKDYHRQFPTIYHLRRHLMCCTEKPDIRLLYLAVAHMIKNRGHFLNEGQDLNQVRRFDDVWQNLCAAVSDVLGIELAVENGAKAAEVLTSSVKIKEKTKQLESVLGEGESEADRSVCKALAGLLAGAKVSAVDLFNGDEALKECGKFSLAEKSIEELEPDLGDALGEDRFSLLQYAYAAYNWAVFARLLPEGKTISEVKTEEYEAYKADLRALKQLVKQYAPDQYYRVFRSAKIKGNYASYVGKTNCGNEKSNPEPCKPEEFFAFLKKELKPLWSQSIPAAASLAAKLESGTLLRRQRSGENAAIPYQAHLQELQIILKNMQQFYPFLQKADENGFTPAYKIEKLLTFRIPYYVGPLNDAHKEKGFCWIVKKADMPVLPWNFDQVVDESACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASMAPAVKLQSIFTEPLPPETLERLAFALTVSGESRKMLQNRIRAILPNADNAVIRKVCALNFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFVEMARGASPEQKNKRTVSRKDQLLALYKACKEDARDWCSELEALPEDKLRSDKLYLYYTQMGRCMYSGELIRLDDLMHDTANQLYDIDHIYPQSKTKDDSLTNRVLVKRQLNAIKSNDYPLPQAMRQTALWKALLEKGLISKQKYLRLTRTTPFTGEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYKLQPLKKGKGQLPLKSSDEHPQPINRYGGYNEVKGAYFVLAAYLKKGKRVKSIESVPLYLAAKLQRDPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLFLQGKFLLEKRDVFAALNPEAQVRQLMEILHLFQCNPVAANLSELGGAAHAGILLASKNIDGKVPVSIVHQSVTGYFSQEVCLNDL

SEQ ID NO: 1487 - protein, 1348 aa, Unknown
  Description of Unknown: uncultivated organism with predicted taxonomy: Clostridiales
  MG18-136 effector
MDQNKEYYIGLDGGTDSVGWAVLNPDYTVVKKRGKSLWGVRLFESGQTAAERRLARSARRRTDRKKWRLKLLKELFAEEVAACDPAFFARLAESRYWEDDKKVDGADTLFHDADFTDKDYHRQFPTIYHLRRHLMCCTEKPDIRLLYLAVAHMIKNRGHFLNEGQDLNQVRRFDDVWQNLCAAVSDVLGIELAVENGAKAAEVLTSSVKIKEKTKQLESVLGEGESEADRSVCKALAGLLAGAKVSAVDLFNGDEALKECGKFSLAEKSIEELEPDLGDALGEERFSLLQYAYAAYNWSVFARLLPEGKTISEVKTEEYEAYKADLRALKQLVKQYAPDQYYRVFRSAKIKGNYASYVGKTNCGNEKSNPESCKPEEFFAFLKKELKPLWSQSIPAAASLAAKLESGTLLRRQRSGENAAIPYQAHLQELQIILKNMQQFYPFLQKADENGFTPAYKIEKLLTFRIPYYVGPLNDAHKEKGFCWIVKKADMPVLPWNFDQVVDENACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASIAPAVKLQSIFTEPLPPETLERLAFALTVSGESRKMLQNRIRAILPNADNAVVRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGASPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQAMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQLNPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGVAHAGILLASKNIDGKVPVSIVHQSVTGYFVQEVCLNDL

SEQ ID NO: 1488 - protein, 913 aa, Unknown
  Description of Unknown: uncultivated organism with predicted taxonomy: Dorea sp. OM02-2LB
  MG18-137 effector
NMQQFYPFLQKADENGFTPAYKIEKLLTFRIPYYVGPLNDAHKEKGFCWIVKKADMPVLPWNFDQVVDENACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASMAPAVKLQSIFTEPLPPETLERLAFALTVSGESRKMLQNRIRAILPNADNAVVRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGASPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQAMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQLNPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGVAHAGILLASKNIDGKVPVSIVHQSVTGYFVQEVCLNDL

SEQ ID NO: 1489 - protein, 988 aa, Unknown
  Description of Unknown: uncultivated organism with predicted taxonomy: Phascolarctobacterium
  MG18-138 effector
MQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTLLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIHKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1490 - protein, 1218 aa, Unknown
  Description of Unknown: uncultivated organism with predicted taxonomy: Phascolarctobacterium succinatutens
  MG18-139 effector
FLFDNLDASTVNDFNAVFSEVENYVHDEMGLEDWSCQNKDALAKVLCDVNLGRTTKQKAMQSLLPAKSKQQKAILQLFSGGKAKLAELFDDEELDDCEKKSISFQDDDLDEIEPVLTAALGERYEGLLRFKAIYDWSLLAKILHLDTGKKEEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIISIQVHLAELKFILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDYEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQELYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDDYNQKWRIGRKVNMHIYDMLLAKSGNNLYKNRPASQTTDLQEQRELFEKLSLANQIHVIGEVLKLFKCASASANLKLLDKGNACGVIKVSNNILKFKQCVLINQSPTGVFEQEVDLMKL

SEQ ID NO: 1491 - protein, 947 aa, Unknown
  Description of Unknown: uncultivated organism with predicted taxonomy: Phascolarctobacterium succinatutens
  MG18-140 effector
VHLAELKFILDNAEGYLPFLGETDNNGLSVREKIEQIVKFRIPYYVGSLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDYEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQELYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDDYNQKWRIGRKVNMHIYDMLLAKSGNNLYKNRPASQTTDLQEQRELFEKLSLANQIHVIGEVLKLFKCASASANLKLLDKGNACGVIKVSNNILKFKQCVLINQSPTGVFEQEVDLMKL

SEQ ID NO: 1492 - protein, 947 aa, Unknown
  Description of Unknown: uncultivated organism with predicted taxonomy: Firmicutes
  MG18-141 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYNDNLYDIDHIYPRSKTKDDSLSNRVLVKKQVNAAKTDIYPLDAAIRTKMHSFWKLIYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1493 - protein, 1056 aa, Unknown
  Description of Unknown: uncultivated organism with predicted taxonomy: Clostridium sp. CAG:964
  MG18-142 effector
AVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYACLLYT

SEQ ID NO: 1494 - protein, 1348 aa, Unknown; identical to SEQ ID NO: 1486
  Description of Unknown: uncultivated organism with predicted taxonomy: Clostridiales
  MG18-143 effector

SEQ ID NO: 1495 - protein, 1348 aa, Unknown; identical to SEQ ID NO: 1487
  Description of Unknown: uncultivated organism with predicted taxonomy: Firmicutes
  MG18-144 effector

SEQ ID NO: 1496 - protein, 951 aa, Unknown
  Description of Unknown: uncultivated organism with predicted taxonomy: Dorea sp. OM02-2LB
  MG18-145 effector
GPELVLWVGVILLRRQRSGENAAIPYQAHLQELQIILKNMQQFYPFLQKADENGFTPAYKIEKLLTFRIPYYVGPLNDAHKEKGFCWIVKKADMPVLPWNFDQVVDENACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASMAPAVKLQSIFTEPLPPETLERLAFALTVSGESRKMLQNRIRAILPNADNAVVRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGASPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQAMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQLNPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGVAHAGILLASKNIDGKVPVSIVHQSVTGYFVQEVCLNDL

SEQ ID NO: 1497 - protein, 947 aa, Unknown; identical to SEQ ID NO: 1491
  Description of Unknown: uncultivated organism with predicted taxonomy: Phascolarctobacterium succinatutens
  MG18-146 effector

SEQ ID NO: 1498 - protein, 1218 aa, Unknown; identical to SEQ ID NO: 1490
  Description of Unknown: uncultivated organism with predicted taxonomy: Firmicutes
  MG18-147 effector

SEQ ID NO: 1499 - protein, 1306 aa, Unknown
  Description of Unknown: uncultivated organism with predicted taxonomy: Lactobacillus oryzae
  MG18-148 effector
LQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEKAVQNYLTDVLQLCEPEIKIPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1500 - protein, 947 aa, Unknown
  Description of Unknown: uncultivated organism with predicted taxonomy: Phascolarctobacterium
  MG18-149 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKISKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEKAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1501 - protein, 947 aa, Unknown
  Description of Unknown: uncultivated organism with predicted taxonomy: Firmicutes
  MG18-150 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKISKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVNKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEKAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1502 - protein, 781 aa, Unknown
  Description of Unknown: uncultivated organism with predicted taxonomy: Phascolarctobacterium
  MG18-151 effector
FQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTDISNVKQCILINQSPTGIFEQEVDLMKL

SEQ ID NO: 1503 - protein, 947 aa, Unknown; identical to SEQ ID NO: 1500
  Description of Unknown: uncultivated organism with predicted taxonomy: Phascolarctobacterium succinatutens
  MG18-152 effector

SEQ ID NO: 1504 - protein, 1010 aa, Unknown
  Description of Unknown: uncultivated organism with predicted taxonomy: Firmicutes
  MG18-153 effector
VHCGFFILFFVQVDYTIYHKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTLLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIHKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1505 - protein, 1056 aa, Unknown
  Description of Unknown: uncultivated organism with predicted taxonomy: Phascolarctobacterium succinatutens
  MG18-154 effector
VQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1506 - protein, 1046 aa, Unknown
  Description of Unknown: uncultivated organism with predicted taxonomy: Phascolarctobacterium succinatutens
  MG18-155 effector
LAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1507 - protein, 759 aa, Unknown
  Description of Unknown: uncultivated organism with predicted taxonomy: Clostridium sp. CAG:964
  MG18-156 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYNDNLYDIDHIYPRSKTKDDSLSNRVLVKKQVNAAKTDIYPLDAAIRTKMHSFWKLIYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFK

SEQ ID NO: 1508 - protein, 988 aa, Unknown
  Description of Unknown: uncultivated organism with predicted taxonomy: Ruminococcaceae bacterium
  MG18-157 effector
MYHLRYALATQAGPFDVRLLYLAVQHIAKHRGHFLFDNLDASKVNDFNAVFSEVENYVRDEMGIEDWSSQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGHWPLKAG

SEQ ID NO: 1509 - protein, 814 aa, Unknown
  Description of Unknown: uncultivated organism with predicted taxonomy: Clostridium sp. CAG:964
  MG18-158 effector
FITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASA

SEQ ID NO: 1510 - protein, 767 aa, Unknown
  Description of Unknown: uncultivated organism with predicted taxonomy: Phascolarctobacterium succinatutens
  MG18-159 effector
MKSYNDFRRIFGEDYIQLHRDEIENIIRWITLFCDEKKMLVTKIKNTYPQISDDEIKAIKKLKYKDWGRLSTTLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1511 - protein, 815 aa, Unknown
  Description of Unknown: uncultivated organism with predicted taxonomy: Clostridiales
  MG18-160 effector
DVLPKQSPLYSRYMVLNELNNIRVDGIRLPVEVKQQAYKDLFLSLPKVSMKKFREYLRTINIQGEISGIDGEFQGSLKPHIDLKRIFGPARNLGAMGEDIIRWIVLFGEAKNILRKKIAEKYDLTEEQMKGVLRLHYSGWGRFSEKFLNGIRDVNKETGEVGDTVIESLWNSSQNLMELLGREHHFLGAISMHNDAFGSSDRITYQTVQDLYVAPAVKRQIWQALTIVKELKGVMGREPKRVFIEMARGPGEKKRTVSRKDALIELYKTLKSDERDWINEIAVQPEDRFRSDRLYFYYLQLGKCLYTGKPIDLDQIYNEMVYDVDHIYPQSKVKDDSLVNRVLVDSTKNKEKSDRYPIDKEIRDRMKPFWKMLLQQGFMEKEKYERLTRSTPFSDNELAEFIARQLVETRQSTKAVAEILQQVYPLSKIVYVKAGLVADFRRYMGHVKCREVNDYHHAKDAYLNIVAGNIYHTRFTDNPYNFIKEAKDKDQKYSLKLEKLLTRDIRRGDITAWDTTGNKTRGVVEKVLARNDIRFTRYPYTEKGQLFDVTLMKKGLGQLPIKANLPIEKYGGYNKVKGAYFMLVEHTDKKGKRIRTLKDVPVHLASQLATDVKKQEYCLDLGMKDPVIRYSKIKMKSLVEVDGFRMHISGRKGDALVLSHAHELVIGEYWEQYIKKLVKFRERAQAFSKSNRGMNLKITTYDGIDGNNNMELYDLFVSKLNNTIYQLKLSKQGTDLLDERERFLNLTIEEQVGILLEILNFFKCNRTSSDLKLLGKGGQAGNLSINSTISGYQTFKLINQSPTGVFEESVDLLKV

SEQ ID NO: 1512 - protein, 1098 aa, Unknown
  Description of Unknown: uncultivated organism with predicted taxonomy: Firmicutes
  MG21-1 effector
MTSHSIRYTLGLDIGIASVGWAVLRNGSDSEPYRIETLGVRIFDKAEVPKTGASLAAPRREARSSRRVVRRRRHRKERIKYLIEQEGIMTQAEMTRLFQNSSFEKSVYEIRVEALDRMLTREETVRLLIHFAQRRGYKSNSKAEEAKDNENGVIKQAISQNKQAMKAHGYRTFGEMLLMDERFYYTQPDGSRIFIPHNKASDYKVTAERSMLADELHMIFAAQRSLGSLWFSDTFETAYMDVWSSQRSFDEGPGGDSPYGGSQIEKMLGTSSDGESRAPKASYSAEYFRLLQDVNHLRIVSLDGTSSPLTQEQRDIVVAASKKSGTLTYTQLRKKLALADDQYFNALYYGDKTAVEVEKKRFGHLQFYHQLRTALDTVEKGAADTLTWAQRDEIARILTVYKADVRRTDELRKAGIPAEYIRALLPLSPTRAMHLSVTAIRKMIPHLEAGMSYSDAYSKAYGNQSTASAAPKKNKLSLNDIEEITNPVVRRAVSQSIKVINAIVRQYGAPERVRIELAREMGKNFKDRGKIAKSQADHAAKNERIKAQISEYKSDHITGQDIVKFKLFKEQDGICLYSGKSLDIARLFEPGYVDVDHIIPYSISFDDSYNNKVLVLSSENRQKGNRIPYAYFGQNSDRWEKYETLVSNTVRSYRKRKNLLLKSLSEAQIDGFKQRNLQDTQYLSKVIFRLIENHLQFAETAPGKKHTQPVNGAITAQVRKRLGIEKIREDGDLHHAVDAAVIACITPGMIQKITKYAQNHERFYATAKGYVDIETGEVLTRSEYEAMDDIRFPEPWPGFRSELEARVSEHPQEAIARLKLPHYENSEEIRPIFVSRMPNHKVTGAAHLETIRSKKGGAGSTVTKTALPDLKLDKNGEIAGYYRKEDDPLLYEALKARLKAFGGDGKKAFAEPFHKPKHNGEPGPIVKKVKIQESATLTVPVNHGIAANGSMVRLDVFHVDGDGYYFVPIYTSDTVKPELPNRAVVAGRRVQEWKVMDDSYFKFSLYPKDLIRIRSKKGIKLKAVNRNADLQEYSTNDCLCYFVKFNISTGALSVENHDRKFEQPGLGGKTLLSIEKYQVDVLGNYSPVALPEKRMKFR

SEQ ID NO: 1513 - protein, 915 aa, Unknown
  Description of Unknown: uncultivated organism with predicted taxonomy: Roseburia sp. AM23-20
  MG21-3 effector
HNTSGVYDLTVARTFIEEEAHKLFAAQRQFGNAFATENIENEYCEILLSQRHFSDGPGGERTFKFDLRGNCTFEKDELRAFKACYTFEFFKLLQDINHLRIIPEYRKGSNKQTRPLTPEERQKIIDLCLKSSSIDFSKLRKELKLADDEIFNRVGYDVKKKKSKKKDAEEQPEEQLTPEQQRTKCEEATKFTQMQSYHEMRKALDKVAKGTISKFSHDKLDEIGEILSLYKADDKRRERLEQIGLSNEEIEALLPLTFTKAGNLSLGAMRKLIPYLEQGLTYDKACEIVYGDHRAQYKGERMPLLSFGKLKEEGALDSVNNPVVLRAIAQTFKVVNAIIRRYGSPQAIHIELARDMKRNFADRQDIKSKQKDNWSENNRRREKVEEIKGSVATGQDIVKMKLYEDQNGVCLYSGKQLELHRLFEVGYAEVDHIVPYSKCFDDSYNNKVLVFSSENQRKGNRLPLEYMLAEGDEDKLDDYVTLVEANIKNTRKKQRLLKPCLTEQDITDWKARNLTDTQYITKAVADILRNYLAFEEDSPFIKKPVRSINGAVTDQVRKRLGLQKHREEGDLHHAMDAAVIAVTTDGYINRISRYTQRREFGKRIGCYKDKQTGEKVEIERQKGQAPLYIDPETGEKLTEQVFDHKYAPTFPAPWKEFTKELKARMAPNADEAIRQLYLPSYGSEEIKPIFVSQMPDRKISGQAHAETIRSARIDVDESGKERIIAVAKTPLTSLKLDKDGEIDGYYMPSSDRLLYEELKNRLIKTKTSGKTYGNAEQAFKEPVYKPKKDGSQGPRVYKVKTWKPTTSNVKVAGGIAKKGDIVRVDIFHITGGKDQGYYFVPIYVADTIKNTLPKHAVVTNFKSSKVEWKEMDDSNFIFSLYKGDLIHIELCADCRDKDSNNKIRKAKDMYVYYDG

SEQ ID NO: 1514 - protein, 1166 aa, Unknown
  Description of Unknown: uncultivated organism with predicted taxonomy: Clostridiales
  MG21-4 effector
MHYILGLDIGITSIGWAVIESDQDGAPFKIADLGVRIFKAAEQPKTGSSLALPRRSARSLRRRLWRKAHRKERIKLLLDRVGLITKENLEKLFSASSFEKDVYTLRSEGLDRKLNNEEWARVLYHLAQRRGYRSSSKAEEADTKNDAGKLLKAVKNNSDKMAQNNFRTVGEMFCKDSSDLFQVKDGSGHVIGRKTHNTSGVYDLTVARTFIEEEAHKLFAAQRQFGNAFATENIENEYCEILLSQRHFSDGPGGERTFKFDLRGNCTFEKDELRAFKACYTFEFFKLLQDINHLRIIPEYRKGSNKQTRPLTPEERQKIIDLCLKSSSIDFSKLRKELKLADDEIFNRVGYDVKKKKSKKKDAEEQPEEQLTPEQQRTKCEEATKFTQMQSYHEMRKALDKVAKGTISKFSHDKLDEIGEILSLYKADDKRRERLEQIGLSNEEIEALLPLTFTKAGNLSLGAMRKLIPYLEQGLTYDKACEIVYGDHRAQYKGERMPLLSFGKLKEEGALDSVNNPVVLRAIAQTFKVVNAIIRRYGSPQAIHIELARDMKRNFADRQDIKSKQKDNWSENNRRREKVEEIKGSVATGQDIVKMKLYEDQNGVCLYSGKQLELHRLFEVGYAEVDHIVPYSKCFDDSYNNKVLVFSSENQRKGNRLPLEYMLAEGDEDKLDDYVTLVEANIKNTRKKQRLLKPCLTEQDITDWKARNLTDTQYITKAVADILRNYLAFEEDSPFIKKPVRSINGAVTDQVRKRLGLQKHREEGDLHHAMDAAVIAVTTDGYINRISRYTQRREFGKRIGCYKDKQTGEKVEIERQKGQAPLYIDPETGEKLTEQVFDHKYAPTFPAPWKEFTKELKARMAPNADEAIRQLYLPSYGSEEIKPIFVSQMPDRKISGQAHAETIRSARIDVDESGKERIIAVAKTPLTSLKLDKDGEIDGYYMPSSDRLLYEELKNRLKAYGNAEQAFKEPVYKPKKDGSQGPRVYKVKTYKTTTSNVKVAGGIADNGSMVRIDVFHIKEGKDKGYYFIPIYVADTIKQKLPQKAVVAAKSIDQWKEMDDEDFIFSLYPGDLVRVEHKKDIVFKSTDKNSSDTISCKNLLTYYSGANISTGAITITNHDRSYIVHGLGIKTLQLLEKYEVDVLGNYHKVRLPEKRQAFNLKYSQKKQ

SEQ ID NO: 1515 - protein, 1166 aa, Unknown; identical to SEQ ID NO: 1514
  Description of Unknown: uncultivated organism
  MG21-5 effector

SEQ ID NO: 1516 - protein, 1166 aa, Unknown; identical to SEQ ID NO: 1514
  Description of Unknown: uncultivated organism
  MG21-6 effector

SEQ ID NO: 1517 - protein, 1136 aa, Unknown
  Description of Unknown: uncultivated organism with predicted taxonomy: Clostridium sp. CAG:571
  MG21-7 effector
MGYRIGLDIGITSVGWSVIEDDSNGNPIRIIDLGSRIFDAAEKPKDGSPLAKERRDARGLRRRLRRKKYRVERTKRLLERYDIITKKEVDEMYANKAHVKHLYNVYELRVLGIEQKLTNKELARVLISLVKKRGYKSNSKAEESNGEAGKLLTATRDNELLMQSKGYRTVAEMYLKDDKFKAKDKNGEILVDKDGSPLLKIKNSTGDYKNTTLRKLLVEEIKLILNKQKELNSKITDDFINEYLKIFESQRNFDDGPGFPSPYGGNLIENMLGNCTFEKEEKRAPKATYTFEYFKFLQTLNHIKIETINKKDDGTINKEKRELTSEEKEKLKELVFSKVTVTYSDVRKTLQLESNQRFNMFTYRDLLNYTEETNKEIEKEKKLKEFESYKKIKTALNHIEKNYITKLTTDDLDEIGYALTVYKSNDKRKEYLEKHTPNLSKEAIEELLKLSFSKVGNLSLKAMKKIIPELEKGVTYDKAVDKVYEDFRGTVDTQKKRKLRLKDFEQEISNPVVRRGLSQAIKVLNAITLRYNEKFGKPDVVVVELARELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDAEDWKERNLNDTKYICKYMYNLIRNHLEFSDNANFVRKVWTVNGKLTAHIRKRLGIEKVRDGDTHHAVDATVIAITTQNMINRLTRYYQYVDGRYMNNKGEYIDTYTGEIINAKEYEEKYGIYFPEPWPKFRKELDIRTNCKTRERMIECLEAEKIYTYEDYDDVEPIFVSRMPRRKVTGTAHLDTIRGIKEKDGELKTITKTELTKLKLKDGEIEGYPENCKRDDRLLYEALKNRLIEFNGDATKAFSEPFYKPKSDGTRGPVVNKVKIEANTTMGVKLNDNKAFAANGDCVRLDIFYVENEGYYFIPIYVSDTVKKELPNKACVAGKKYADWKEMRDENFIFSIYPKDLIYIQGKNKIKLNPVIKDKDSIEVEEILAYYVKAGISVAQIAIQTNDNKYNQSSLGIKNLKKLEKYEVDILGNYHKVKLPEKRLPFNINKK

SEQ ID NO: 1518 - protein, 1121 aa, Unknown
  Description of Unknown: uncultivated organism with predicted taxonomy: Clostridiales
  MG21-8 effector
MGGNAMKKEQKHCHYTLGLDIGIASIGWAVLGNNEDGTPNRIIDLGVRIFESAEVQKTGESLAAPRRDARSARRRLRRHRHRLERIRYLLVQQGVLTQEEMTHLYDKSDMVSPYQLRTEGLDRLLNAREFSKVLIHLAQRRGYQSNSTAEEAKNEKENGIIKTAILENQQRMGRGGYRTIGEMMYRDAAFWETINGIRYHCTRNKAGDYRFTVDRASILAEVSILFEAQRRLGAPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGISDEVRFAGLYYGEDTIEKAEKRKWPQMQSYHKIRTALDKVSKDAIQTLTQDQLDAIGEILAGGVSDAKRINSFCLAGIPEEYHKALLPLSISKRAKLSIAAMRKLIPFLQQGMRYDEACKAAGLDFHGADGKVEKLSDFLNEITNPVVRRAVSQTIKVVKAVVDTYSNRKEMKLDAVRIELAREMHHSIKERNRMKKRQEENREKNEQVKAQILETKPGTRVTGLDIVKFKLYQEQDGICPYSGKPLLIERLYEPGYAEVDHIIPYSRCFDDSYSNKVLVLAEENQQKGNRTPYEYFGANEQRWHEFSARVRASVRDFKKRQKLLNTSFGEEQGKDFIQRNLNDTQHITRVVYNYLRNNLKFADSAYAKAPVRAVNGAVTAMLRGRWGIEKMRGNGDLHHCKDAVVIAATSDSMIKDLTKYYQEEEQLFMGKTHFVDPATGEVLTRKEFQQRFAPKFPQPWDRFREELEVRLDPTNPKEALMALNLSTYEFDPEEEIPPVFVSHMPKHTVTGAAHKETIRGKTETGTAVKTALTSLKLDKNGEIDGYYNPQTDPRLYQALVERLKKFGGDGAKAFAEPFYKPKRDGTPGPRVDKVKIAEKASLSVPTGRGEADNGEMIRIDVFRVPNERKPDDNYYFVPIYVADTKKAILPSKAVVGKKPPEAWKQMKPEHFLFSIFKGDLIYVESKKGISLALAKEAVGEKTIQVKSGLFYFCGADISDGSIKIETHDRRYYKKSLGIKELKAFEKRQVEVLGEVRKVKLPEKRLEFRGRK

SEQ ID NO: 1519 - protein, 1093 aa, Unknown
  Description of Unknown: uncultivated organism
  MG21-9 effector
MHYILGLDIGITSIGWAVIESDQDGKPFKIADLGVRIFKAAEQPKTGASLALPRRSARSLRRRLWRKAHRKERIKLLLDKVGLISKENLEKLFSASSFEKDVYTLRSEGLDRKLNNKEWARVLYHLAQRRGYRSSSKAEEADTKNDAGKLLKAVKNNSDKMAQNNFRTVGEMFCKDSSDLFQVKDGSGHVIGRKTHNTSGVYDLTVARIFIEEEAHKLFAAQRQFGNAFATESIENEYCEILLSQRHFSDGPGGERTFKFDLRGNCTFEKDELRAFKACYTFEFFKLLQDINHLRIIPEYRKGSNKQTRSLTPEERQKIIDLCLKSPDVKFSKLRKELKLEDDELFNRVNYDVKKKKSKKKDAEEQPEEQLTPEQQRTKCEEAAKFTQMQSYHEMRKALDKVAKGTISKFSHDKLDEIGEILSLYKADDKRRERLEQIGLSNEEIEGIGGKLFVLTGNLSLIAMRKLIPYLEQGLTYDKACEIVYSDHRAQYKGERMPLLSFGKLKEEGALDSVNNPVVLRAIAQTFKVVNAIIRRYGSPQAIHIELARDMKRNFTDRQDIKKKQDSNWSYNDKIREKVEELKGSAATGQDIVKMKLYEEQDGYCLYSGKQLDIRRLFEVGYAEVDHIVPYSKCFDDSYNNKVLVFSSENQRKGNRLPLEYMLAEGDEDKLDDYVTLVEARIKNTRKKQRLLKPCLTAEDSNDWKERNLTDTQYITKAVADILRNYLAFEEDSPFIKKPVRSINGAVTDQVRKRLGLQKHREEGDLHHAMDAAVIAVTTDGYINRISRYTQRREFGKRIGCYVDLETGEKLTKQAFEQKYEPTFPAPWNKFTKELKARMAPNADEAIRQLYLPSYGSEEIKPIFVSQMPDRKVSGQAHAETIRSARIDVDGNGKERIIAVAKTPLTSLKLDKDGEIDGYYMPSSDRLLYEELKNRLKAYGNAEQAFKEPVYKPKKDGSQGPRVYKVKTWKTTTSNVKVAGGIADNGSMVRIDVFHIKEGKDKGYYFVPIYVADTIKKELPQKAVVAAKPIDHWKEMDDKDFIFSLYPGDLIRVEHKKDIVFKSTDKNSSDTISCKNLLTYYVFANISTGAIAI

SEQ ID NO: 1520 - protein, 1136 aa, Unknown
  Description of Unknown: uncultivated organism with predicted taxonomy: Clostridiales
  MG21-10 effector
MGYRIGLDIGITSVGWSVIEDDSNGNPIRIIDLGSRIFDAAEKPKDGSPLAKERRDARGLRRRLRRKKHRIERTKRLLERYDIITKKEIDEMYANQAHVKHLYNVYELRVLGIEQRLTNKELARVLISLVKKRGYKSNSKAEESNGEAGKLLTATRENEILMQSKGYRTVAEMYLKDDKFKAKNKKGEILVDKDGTPLLKIKNSTGDYKNTTLRKLLIEEIKLILNKQKELNSKITDDFITEYLKIFESQRNFDDGPGFPSPYGGNLIENMLGNCTFEKEEKRAPKATYTFEYFKFLQTLNHIKIETINIKDDGTINKEKRELRSEEKEKLKELVFSKVTVTYSDVRKTLQLEPNQRFNMFTYRDLLNYTEETNKEIEKEKKLKEFESYKKIKTALNHIEKNYITKLTTDELDEIGYAVTVYKNDDKRKEYLENHTTNLSKEAIEELLNLSFSKVGNLSLKAMKKIIPELEKGVTYDKAVDKVYEDFRGTVNTQKKRKLRLKDFEQEISNPVVRRGLSQAIKVLNAITLRYNEKFGKPDVVVVELARELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNVEEYEIRVNTLIRNNKKKQNLLRQDFTREDAEDWKERNLNDTKYICKYMYNLIRNHLEFSDNPNFVRKVWTVNGKLTAHIRKRLGIEKVRDGDTHHAVDATVIAITTQNMINRLTRYYQYVDGRYMNNKGEYIDIYTGEIINAKEYEEKNGIYFPEPWPKFRKELDIRTNCKTRERMIECLEAEKIYTYEDYDDVEPIFVSRMPRRKVTGTAHLDTIRGIKEKDGELKTITKTELTKLKLKDGEIEGYPDNCKRDDRLLYEALKNRLVEFNGDAAKAFSEPFYKPKSDGTRGPIVNKVKIEANTTMGVTLNDGKAFAANGDCVRLDIFYVENEGYYFIPIYVSDTVKKELPNKACVAGKKYADWKEMKEKDFIFSIYPKDLLYIQGKNKIKLNPVVKDKDPIEVEEILAYYLKIDISTATIEIKSNENKYVKRGLGGKGLKKLEKYEVDILGNYHKVKLPEKRLPFNINKK

SEQ ID NO: 1521 - protein, 1136 aa, Unknown
  Description of Unknown: uncultivated organism with predicted taxonomy: Clostridiales
  MG21-11 effector
MGYRIGLDIGITSVGWSVIEDDSKGNPIRIIDLGSRIFDAAENPQDGSALAKERRDARGLRRRLRRKKHRIERTKRLLERYDIITKKEIDEMYANQAHVKHLYNVYELRVLGIEQRLTNKELARVLISLVKKRGYKSNSKAEESNGEAGKLLTATRDNEILMQSKGYRTVAEMYLKDDKFKAKDKNEEILVDKDGIPLLKIKNSTGDYKNTTLRKLLIEEIKLILNKQKELNSKITDDFITEYLKIFESQRNFDDGPGFPSPYGGNLIENMLGNCTFEKEEKRAPKATYTFEYFKFLQTLNHIKIETINIKDDGTIKKEKRELTSDEKEKLKELVFSKVTVTYSDVRKTLQLEPNQRFNMFTYKDLLNYTEETNKEIEKEKKLKEFESYKKIKTALNHIEKNYITKLTTDELDEIGYALTVYKNDDKRKEYLENHTTNLSKEAIEELLKLSFSKVGNLSLKAMKKIIPELEKGVTYDKAVDKVYEDFRGTVNTQKKSKLRLKDFEQEISNPVVRRGLSQAIKVLNAITLRYNEKFGKPDVVVVELARELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDSEDWKERNLNDTKYICKYMYNLIRNHLEFSDNTNFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECIEAERIYTYEDYNDVEPIFVSRMPRRKVTGPAHVATIRGVKEKDGELKKITKTELTKLKLKDGEIEGYPENCKRDDRLLYEALKNRLIEFNGDATQAFSEPFYKPKSDGTRGPVVNKVKIEANTTMGVILNDKKAFAANGDCVRLDVFYVENEGYYFIPIYVSDTVKKELPNKACVAGKKYADWKEMKDEDFIFSIYPKDLIYIQGKNKIKLNPVIKDKEPIEVEEIFAYYVKAGISSAAITIQTNDSKYVQPSLGIKSLKKLEKYEVDILGNYHKVKLPEKRLPFNINKK

SEQ ID NO: 1522 - protein, 1088 aa, Unknown
  Description of Unknown: uncultivated organism with predicted taxonomy: Helicobacter sp. MIT 11-5569
  MG21-12 effector
MHYILGLDIGITSIGWAVIESDQDGVPFKIADLGVRIFKAAEQPKTGASLALPRRSARSLRRRLWRKAHRKERIKFLLDKVGLISKENLEELFLASGFEKDVYTLRAEGLDRKLNNEEWARVLYHLSQRRGYKSSSKAEESDKDNKEAGKLLNAVKSNSDKMKQNNFRTVGEMFCKDNSDLFQVKDGSGHIVGRKTHNTSGVYDLTIARNLIEAEVHKLFAAQRQLGNAFATESIENEYCEILLSQRHFSDGPGGERTFKFDLRGNCTFEKDELRAFKACYTFEYFKLLQDINHLRIIPEYRKGSAKQTRPLTPEERQKIIDLCLKSPSIDFSKLRKELKLADNELFNRVNYDVKKKKGKKKDTEEQSEEQLTPEQQRLKCEKAAKFQQMQSYHEICKALDKVAKGTISKLSHDQLDAIGEALSLYKADDKRRERLEQIVLSNEEIEALLPLDSTKAGNLSLIAMRKLIPYLEQGLTYDKACEQVYGDHRAQYNGERMPLLSFGNLKEEGALDSVNNPVVLRAIAQTFKVVNAIIRRYDSPQAIHIELARDMKRNFADRQDIKKKQDNNWSCNDRIRQKVEEYKGSAATGQDIVKMKLYEEQNGVCLYSGKQLDIHRLFEVGYAEVDHIVPYSKCFDDSYNNKVLVFSSENQSKGNRLPLEYMLAEGDEDKLDNYVTLVEAFIKNTRKRQRLLKPCLTAEDSSDWKERNLTDTQYITKAVADILRNYLAFEEDSPFAKKPVRSINGAVTDQVRKRLGLQKHREEGDLHHAMDAAVIAVTTDGYINRISRYTQRREFGKRIGCYKDKQTGEKVEIEKQKGQAPLYVDPETGEKLTEQAFDQKYAPTFPAPWPEFTKELKARMAPNADEAIRQLYLPSYGSEEIKPIFVSQMPDRKISGQAHAETIRSARVDVDESGKERIIAVAKTPLTSLKLDKDGEIENYYMPSSDRLLYEELKNRLKAYNNDPKEAFKEPVYKPKKDGSQGPRVYKVKTWKTTTSNVKVAGGIADNGSMVRIDVFYVKEGKDKGYYFIPIYVADTIKKELPQKAVVQGESMNNWKEMDDKDFIFSLYPGDLVRVEHKKNIEIGRAS

SEQ ID NO: 1523 - protein, 1132 aa, Unknown
  Description of Unknown: uncultivated organism with predicted taxonomy: Clostridium
  MG21-13 effector
MGYRIGLDIGITSVGWAAIEDDANGNPKRIIDLGSRIFEAAEKPKDGSPLAKDRRDARGLRRRLRRKKHRVERTKRLLERYNIITKKELEDLYENYRFQYNVYELRVMALDEKITNKDLARILISMVKKRGYKSNSKSEEIASGSDAGKLLTATKENEELMKEKGYRTVAEMYLKDDKFKLKNSNGEYILYKKGRKQIKIRNSINEYKNTALRKLLVDEIKLILEKQRELNSSINDNFIKEYLEIFESQRSFDEGPGEPSPYGGNQIEKMLGNCTFEKEEKRAAKASYTFEYFKLLQDINHIKINKYDLETRKIEKRELTEEERQKIIKIVKEKANVTYSSLRKELNLSRTERFNMLSYKNILMWSDETNEEVEKTAKFKEFESYNKIKTALNRVEKGYIEKLTTEELDKIGYALTVYKNDDKRIAYLKENTQNLTEEAIQELLKLSFTKVGNLSIKAMKKIIPELEKGITYDKAVDNVYEDFRGIVNTEKKRKLRLQDLEQEISNPVVRRGISQAIKVLNAITLRYNEKYGKPDVVVIELSREMGKNFNDRSKIKKSQEENMQRNENIRQAIIELGKSNPTGQDIVKYKLWQEQDNFCVYSGKKITVDMLFTEAVDVDHIIPYSMCFDDTYNNKVLVLASENRQKGNRVPYKYEKEIGRNIDEYVVRVGNIIKNPKKLRRLLREDFTKEDAKDWKNRNIQDTQYMCKLMYNLVRNHLEFSDNKNFERKVWTVNGSVTAHIRKRLGIEKTRDGDTHHAVDAAVIAITTQNMINRITKYYQYNDGKYMNNKGEYIDLETGEILDAKEYEAKNGIYFPEPWPKFRKELDIRVNCNSKERMIECLNAEKIFTYEDYEDVEPIFVSRMPRRKVTGMAHLETIRGLREENGSLKTITKTELAKLKLDKSGEIEGYPEKNKKDDKLLYDALKEQLTKFGGDGKVAFKKDFYKPRADGNKGPIVRKVQIEANATLGVTLKDREGFAGNGDCVRLDIFYVEGEGYYFVPIYVSDTIKEKLPNKACVQGKKYEEWKEMREEDFIFSLYPKDLIYVKGKNKIKLNATNKSGEQIEVEDTMAYYINAGISVAQITIQTHDNKYEQPSLGIKSLKELKKYEVDVLGNYHEVKIPEKRMPFNIKK

SEQ ID NO: 1524 - protein, 1169 aa, Unknown
  Description of Unknown: uncultivated organism with predicted taxonomy: Clostridiales
  MG21-14 effector
MGYRIGLDLGISSIGWACVEDKENGEPKRIIDLGTRIFDRAENPKDGAPLAAPRREARELRRRLRRRNHRIKRTKILLEKYDIISQQEIEKMYENYNFPNTPYELRVIGLDNKLTNKELARVLISLVKKRGYKSNSKSEESNDKETGKLLTATKDNENLMKEKGYRSVAEMYLKDEKFKMRLPNGQIATRIDKNTGKEIEIIKIKNSINDYKNTPLRKLLVEEIKLILNKQKEYNPKITDQFINEYLNIFTSQRNFDEGPGEPSPYAGNQIEKMLGKCTFEREEYRAPKSTYTFEYFKLLQDLNHIKIIKYELKQDNEIVQTVRTLTEEERKKLIELAKKTPTLNYYKIRKEIKLKENERFNMCRYKSTREFTDDVNKEAENDNKKIKEFQSYHEIRKALDKYKKEYIQELSTNDLDSIGYALCVYKNDKKRIEYIKTNVTQIPDEVINYLLPLSFSKVGNLSLKAMKKIIPYLEKGLTYDKAVNELGKIDSNYSDFRGVVNTEKRRKLSINNLEDNISNPVVRRAVSQTIKVLNAITLKYNSIYGKPDLVVVELARELGKSFKERQSIEKIYEENRTRNEKAIQEIRELGKTNVTGKDIVKYKLWKDQNEICIYSGKHIKVEDLFTDAVDIDHIIPYSQCFDDTYKNKVLVLASENRQKGNRTAYKYIKEAGKNLEEYEVRVNNYIKDYRKKERLLKADFSTEDAKNWKDRNIEDTQYISRLVYKLINNYMEFSDNPNVNRKVRNINGAVTHYIRNRLGIEKIRADGDEHHAVDACIIATTSNYMVNKITRYSQYIDGRFMNDRGEYIDIETGEIINKEEYEEEYGPKFPEPWEGFRRELEIRSSDDVANRAEKTPEELKNIMIQEINDEIKNGKLYSYIEHDDGINRFDDIEPIFVSRMPRRKVKGQAHMETIRGIEKENGKLKTVTKTPLTKLKLDDNNEIKNYSKKAKQDDKLLYDALVEQLKKFNGKGEEAFKEPFFKPKKDGSKGPIVNTVKIEENATLGVEFKEGKAFAGNGNMVRIDVFYVEGEGYYFIPIYVADTIKKELPNKACVANKGTDKWKTMDDKNFIFSLYPNDLIYIESEKGIKLNGNNDNKKEQIEVKKLFAYYVKAGISTAAITIDNQDGEYTQPGLGIKGLKKIEKYDIDVLGNYHKIKLPEKRIKFNIN

SEQ ID NO: 1525 - protein, 1133 aa, Unknown
  Description of Unknown: uncultivated organism
  MG21-15 effector
MGYRIGLDIGITSVGWAVIEDDIEGKPKRIIDLGSRIFDAAENPKDGSALAKVRRDARGIRRRGRRKKHRIERTLHLLERHHIISKKEWISMFENYNFQFNIYELRVKALEEKITNKDLARILVNFVKKRGYKSNSKSEENDSSNDAGKLLTATKENQNIMQEKGYRTIGELYLKDDRFKLKDKNGDYILDKNGQKIMKVRNTTNDYKGTALRTLISDEIKLILNKQKEYTSLITDEFIQEYISIFESQRNFDEGPGEPSPYAGNQIEKMLGFCTFEKEERRAPKATYTFEYFKLLQDINHIKIEKLSLDDNMQRVKSKRSLVKDEKEKIIELVKSKTKISYYDIRKALNLQENERFNMFTYKNVLLWNNETNAEVEKDKIFKEFESYNKIKTALNRIEKNYILKLNTDELDYIGYALTVYKNDEKRISFLKENTSLPDRIINELLNLSFTKVGNLSLKSMKKIIPYLENGLTYDKAVNSVYEDFRGEINTEKKQKLRLKDLEEDISNPVVRRGISQAIKVLNAITLRYNAKYGKPDVVVIELAREMGRNFKDRNIIKKSQEINMKNNEFVKERIVELGKENPRGQDIVKYKLWQEQDGVCIYSGKKIPIENLFTEAVDVDHIIPYSMCFDDTYNNKVLVLASENRQKGNRVPYKYEKEIGRDIEEYEVRVNNIIKNPYKRVKLLREDFTREDALEWKDRNIQDTQYICKLMYNLVKNHLEFSNNKNFDRKVWTVNGAITSHIRKRLGIEKTRDGDIHHAIDAVVIAITTQEMINKLTKYYQYKDGKYMNNKGEFIDLETGEILDAEKYEKENGIYFPEPWPKFRKELEIRTICPTKETMISYLHNEKIFTYDDYEDVEPIFVSRMPKRKITGTAHLETVRGFEKRDNEIYTITKTELKKLKLDKDGEIEGYPEKNKRDDRLLYDALREQLKRYNNDGEKAFKDDFYKPRKDGSRGPLVKKVQIESKTTLGVELKNKGFAANGDSVRIDVFYIEGDGYYFIPIYVSDTIKKELPNRACVPNKTYSEWKEMDEKNFIFSLYPKDLLYIKGKNKIKLNPTNKIDEPIEVEETMAYYVKAGISVASITIQTHDNKYQQPNLGIKTLKKLKKYEVDVLGNYHEVKLPEKRMPFNIKK

SEQ ID NO: 1526 - protein, 1166 aa, Unknown
  Description of Unknown: uncultivated organism
  MG21-16 effector
MHYILGLDIGITSIGWAVIESDQDGVPFKIADLGVRIFKAAEQPKTGASLALPRRSARSLRRRLWRKAHRKERIKLLLDKVGLISKKNLEKLFSASSFEKDVYTLRAEGLDRKLNNEEWARVLYHLAQRRGYRSSSKAEEADKDNKEAGKLLNAVKSNSDKMKQNNFRTVGEMFCKDNSDLFQVKDGSGHIVGRKTHNTSGVYDLTIARNLIEAEVHKLFAAQRQLGNAFATESIENEYCEILLSQRHFSDGPGGERTFKFDLRGNCTFEKDELRAFKACYTFEYFKLLQDINHLRIIPEYRKGSAKQIRPLTPEERQKIIDLCLKSPGLDFSKLRKELKLEDDELFNRVSYDVKKKKGKKKDTEEQSEEQLTPEQQRLKCEKAAKFQQMQSYHEMRVALDKVAKGTISKLSHDQLDGIGEVLSLYKADDKRRERLEQIGLSNEEIEALLPLKFTKAGNLSLTAMRKLIPYLEQGLTYDKACEIVYSDHRAQYNGERMPLLSFGKLKEEGALDSVNNPVVLRAIAQTFKVVNAIIRRYSSPQAIHIELARDMKRNFTDRQDIKKKQDNNWSYNDRIRQKVEELKGSAATGQDIVKMKLYEEQNGVCLYSGKQLDIHRLFEVGYAEVDHIVPYSKCFDDSYNNKVLVFSSENQSKGNRLPLEYMLAEGDEDKLDNYVTLVEAFIKNTRKRQRLLKPCLTAEDSSDWKERNLTDTQYITKAVADILRNYLAFEEDSPFAKKPVRSINGAVTDQVRKRLGLQKHREEGDLHHAMDAAVIAVTTDGYINRISRYTQRREFGKRIGCYKDKQTGEKVEIEKQKGQAPLYVDPETGEKLTEQAFDQKYAPTFPAPWPEFTKELKARMAPNADEAIRQLYLPSYGSEEIKPIFVSQMPNRKVSGQAHAETIRSARVDVDESGKERIIAVAKTPLASLKLDKDGEIENYYMPSSDRLLYEELKNRLKAYDSAEQAFKEPVYKPKKDGNRGPRVYKVKTWKKTTSNVKVAGGIADNGSMVRIDVFYVKGEGYYFIPIYVADTIKKELPQKAVVDKSVAVKHGWKEMNDKDFIFSLYPGDLIRVEHKSQIVLKSTQKNSKDTKVGKEFFLYYKSANISNGAIDASYHDQSYEKEGLGIKTLQSFEKYEVDVLGNYHKVHLPEKRQAFNLKYSQKEQ

SEQ ID NO: 1527 - protein, 1100 aa, Unknown
  Description of Unknown: uncultivated organism with predicted taxonomy: Clostridiales
  MG21-17 effector
MSDFHYALGLDIGIGSVGWAVLRNQPNGEPDRIQDLGVRIFDKAEQPKTGASLAAPRRDARSARRRLRRHRHRLERIRYLMEQHDIMSVSDIQAMYTAGGFKKSPYQLRAEALDRPLSKEETVRVLIHLAQRRGYKSNSMAEAAKDEKETGKVKSAIEENRACMEQHGYRTVGEMMFRDERFWQNNPDGTRYHKTRNKVEDYRFTVERSDIVNEAKQIFAAQRQFGTGWLDDGMETAYLSILESQRSFDEGPGGDSPFRGGIGERVGSCTFEPDEQRAAKATYTFEYFKLLQDLNHMRLAGNGMAPRPLTAQQREILKAAALQSASLSYGQLRKKLALDDDVFFSGLCYGDKLKEEAEKRKWPQMQSYHKMRTALDKVGKGTIGTLTEFQLNAIASILTQYKSDARRIAALREAGIPMQFDEALLPLSFSKYGNLSVKAMQRLIPLLEQGMRYDEACTQIYGDHRGLHSEQRKSKLSLNDMEEITNPVVRRAVSQTIKVVNAVVRTYGPPDVVRIELAREMSQNFDDRRKAEKRQEENRAANERVKEQIAEYKGDRATGLDIVKFKLYREQDGVCLYSGKNLDIGRLFEPGYADVDHIIPYSRCFDDSYQNKVLVLASENRQKGNRLPYEYFGQDETRWHEYEVRVENLIRNYRKRQKLLKKQLTEEESTGFIDRNLKDTQYITRSIYNLLRDNLAFAESRYSKKPVQTVNGAVTSMLRSRWGVQKIREDGDLHHCMDAAVIAATSPGLVQRLTEYSKRREALEEAPRGYVDPSTGELVEQSEQPRRDPFPKPWEQFHQELEARLATVDPRHQIDLLKLATYESDEEVKPVFVSRMPNHKVTGAAHAETIRSSKGGDGYTVTKTPLISLKLNKSGEIDGYYNWSSDKLLYDALLARLKEFGGDGAKAFAEPFYKPKRDGTPGPRVDKVKICERATTGLPVRDGIAANGSMVRIDVFYVEDEGYYFVPIYVADTKKECLPNKAVVAYKAYSDWKEMTDENFIFSLYPGDLVRIQSRKGIKLNIAKGGTGEKEIVRQDGMYYYQTANISSGAITISTHDRRYSQPSLGIKTLQSIEKYQVDVLGNYYKVDLPEKRMSFSEEG

SEQ ID NO: 1528 - protein, 1007 aa, Unknown
  Description of Unknown: uncultivated organism with predicted taxonomy: Clostridiales bacterium 42_27
  MG21-18 effector
AMFAAGGFKKSPYRLRAEALDRLLSKEETVRVLIHLAQRRGYKSNSMAEAAKDEKETGKVKSAVEENRACMEQHGYRTVGEMMFRDERFWQSNPDGTRYHQTRNEAEDYRFTVERSDIVNEAKQIFAAQRQFRADWMDDGMEAAYLSILESQRSFDEGPGGDSPFRGGIGEKVGFCTFEPEEHRAAKATYTFEYFKLLQDLNHMRLAGSGTAPQPLNAQQREILKAAALQSASLSYGQLRKKLALDDDVFFNGLYYGDKPREEAEKRKWPQMQSYHKIRTALNKAGKGTIRSLTEEQLNAITSILTQYKSDARRIEKLREAGIPELFDNALLPLSFSKYGNLSVKAMQRLIPLLEQGMRYDEACTQIYVDHRGLHPEQRKNRLSLNDMEEIINPVVRRAVSQTIKVVNAVVRTYGPPDVVRIELAREMSRNFDDRRKAEKRQEENRAANERAKEQIVEYKGDCATGLDIVKFKLYREQDGVCLYSGQNLDLSRLFEPGYVDVDHIIPYSRCFDDSYQNKTLVLASENRQKGNRLPYEYFGQDEARWHEYEVRVENLIRNYRKRQRLLKKRLTEDESAGFIDRNLKDTQYITRSIYNLLRDNLAFAESRYSKKPVQTVNGAVTSMLRSRWGVQKIREDGDLHHCMDAAVIAATSPGLVQRLTEYSKQREAFVKAPAGYVDPSTGGLVEQSEASRRDPFPKPWEQFHQELEARLDPIDPQHQIDLLKLATYESDEEVKPVFVSRMPNHKVTGAAHAETIRSSKGGDGYTVTKTPLANLKLNKLGEIDGYYNPGSDKLLYDALLARLKEFGGDGAKAFAEPFYKPKRDGTPGPRVDKVKICEKATTGLPVRDGIAANGSMVRIDVFYVEDEGYYFVPIYVADTKKESLPNKAVVAYKAYSDWKEMIDENFIFSLYPGDLVRIQSRKGIKLNIAKGGTGEKEVVRQDGMYYYRAAGITVGAIQIETHDRRYLQPSLGLKTLQSIEKYQVDVLGNYYKVDLPEKRMKFSKEG

SEQ ID NO: 1529 - protein, 1193 aa, Unknown
  Description of Unknown: uncultivated organism
  MG21-19 effector
MQQKMEKPEMPYVLGLCLSTTSVGWSVLETDETGIPFRIADLGVRTFQEAKTNYKRSKCRTSRRRLQRKSCIKSRVSELFERSGLITKEALEEIFVKSGFEKDIIVLRKDGLDRKLENDEWARVLYNFTQRRGYKVVSAAREISAKKIAEESKKQNSKSNLSNEDKVAQEEAKRHAGLLAAVNNNTKELKKDNYRTIGEMFCSSKDERFMVKDGSNREIGRTTRNKHGIYSFAVSRELIKDEISKLFDAQRKQGNKFADKSFQKEYENIVFSHNDKSQDLRGNCFFEKGEKCAFKGGYTFEYFKLLCELNNIRIISTESKVDEAVRKITESQRNTIIGLYKKSPKLTPKDLSKKLNLKSSEYLRSFNTKQMQSYHEIREALNKVTKNIANDLSNEQFDEIGEILSLYKNDDERREKLQELRINVGLGNNGLGDAEIKSLLELNFSGTGSLSLKAMKNLIPYLEKGLSYGEACEKVYGDHRTQCGGERMEYLSFKKLKEEGALDSINSPVVARATTQAFKVINAVICKYGSPQSVHIELSRDIKCGSRTRERIAQENEANRERREKLINEVENIKKQKHCEKVNATEQEILKLQLYKDQHGKCLYSGKELDKDKVISESGYAEIDHIIPYSQSFDNSEANKVLTLSEENRNKGNDVPVAYILRKHKNSEKEYDAFVKRVKSVTKEVSNTNKDRQKILEKRKQNLLISPNFKVDELEGLLVRETVGVQNIQKRIADILRNYLRFYGEMPMEQHIVVTKNSITEAICEQLGLQRYYTKVSALSSALNAILIAVTPANYEAKVTQYVQSREEHYTDDGYIDPENGKKLTIEEFDAKYMPESDLKCIYSYLKEEIEIWMSSASDKKSINAKRGKLEKLHKKLGLKGKYENEINNWKPIFVSQMPDRKISGQAHAETIRSARIDIDENGKERIIAVAKTPLTSLKLDKNGEIDGYYMPSSDRLLYEELKNRLIKTKTSGKTYGNAEQAFKEPVYKPKKDGSQGPRVYKVKTWKPTTSNVKVAGGIAKKGDIVRVDIFHITGGKDQGYYFVPIYVADTIKNTLPKHAVVTNFKSSKVEWKEMDDSNFIFSLYKGDLIHIELCADCRDKDSNNKIRKAKDMYVYYDGVDFYQSGKCTNQSIGELNGAINVSWHDGSCEDSIHIKEINVLEKYEVDVLGNYHKVRLPERRQAFNLKYSQKEQ

SEQ ID NO: 1530 - protein, 1100 aa, Unknown; identical to SEQ ID NO: 1527
  Description of Unknown: uncultivated organism with predicted taxonomy: Clostridiales
  MG21-20 effector

SEQ ID NO: 1531 - protein, 808 aa, Unknown
  Description of Unknown: uncultivated organism with predicted taxonomy: Clostridiales bacterium 42_27
  MG21-21 effector
VERTKRLLERYDIITKKEVEAMYANQAHVKHLYNVYELRVLGIEQKLTNKELARVLISLVKKRGYKSNSKAEESNGEAGKLLTATRDNELLMQSKGYRTVAEMYLKDDKFKAKDKNGEILVDKDGSPLLKIKNSTGDYKNTTLRKLLVEEIKLILNKQKELNSKITDDFINEYLKIFESQRNFDDGPGFPSPYGGNLIENMLGNCTFEKEEKRAPKATYTFEYFKFLQTLNHIKIETINKKDDGTINKEKRELTSEEKEKLKELVFSKVTVTYSDVRKTLQLESNQRFNMFTYRDLLNYTEETNKEIEREKKLKEFESYKKIKTTLNHIEKNYITKLTTDELDEIGYALTVYKNDDKRKEYLENHTTNLSKEAIEELLKLSFSKVGNLSLKAMKKIIPELEKGVTYDKAVDKVYEDFRGTVDTQKKRKLSIKDFEQEISNPVVRRGLSQAIKVLNAITLRYNEKFGKPDVVVVELARELGKNFADRKAIEKRQNDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDAEDWKERNLNDTKYICKYMYNLIRNHLEFSDNPNFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECLEAEKVYTYEDYDDVEPIFVSRMPRRKVTGTAH

SEQ ID NO: 1532 - protein, 769 aa, Unknown
  Description of Unknown: uncultivated organism with predicted taxonomy: Clostridiales
  MG21-22 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMDEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMEEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQCLTAYNKHRETWERPPAG

SEQ ID NO: 1533 - protein, 861 aa, Unknown
  Description of Unknown: uncultivated organism with predicted taxonomy: Roseburia inulinivorans
  MG21-23 effector
VLIHLAQRRGYQSNSTAEEAKNEKENGIIKSAILENQQRMERGGYRTIGEMMYRDAAFWETINGIRYHCTRNKAGDYRFTVDRASILSEVSILFEAQRRLGSPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGEDTIEKAEKRKWPQMQSYHKIRTALDKVSKNAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDTYSKREEMKLDAVRIELAREMHHSIKERNRMKKRQEENREKNEQVKAQILETKPGTRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNLNDTQHITRVVYNYLRNNLEFADSAYAKAPVQAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHTVTGAAHKETIRGKTETGTVVKTALTSLKLDKNGEIDGYYNPQTDPRLYQALVERLRQFDGEGKKAFAEPFYKPKKDGTPGPRVDKVKIAEKASLSVSTGRGVADNGEMIRMDVFRVPNERKPDDSYYFVPIYVAD

SEQ ID NO: 1534 - protein, 1107 aa, Unknown
  Description of Unknown: uncultivated organism with predicted taxonomy: Firmicutes
  MG21-24 effector
MKKRKKKKKDKKDCHYTLGLDIGIASIGWAVLGNDEDGTPNRIIDLGVRIFESAEVQKTGESLAAPRRDARSARRRLRRHRHRLERIRYLLVQQGVLTQEEMTHLYDKSDMVSPYQLRTEGLDRLLNAREFSKVLIHLAQRRGYQSNSTAEEAKNEKENGIIKSAILENQQRMERGGYRTIGEMMYRDAAFWETINGIRYHCTRNKAGDYRFTVDRASILSEVSIFFEAQRRLGAPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGQDTIEKAEKRKWPQMQSYHKIRTALDKVSKNAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDTYSKREEMKLDAVRIELAREMHHSIKERNRMKKRQEENREKNEQVKAQILETKPGTRVTGLDIVKFKLYQEQDGICLYSGKPMEIERLYEPGYAEVDHIIPYSRCFDDSYSNKVLVLAEENRQKGNRTPYEYFGADEQRWHEFSARVRASVRDFKKRQKLLNTSFGEEQKNEFTQRNLNDTQHITRVVYNYLRNNLEFADSAYAKAPVQAVNGAVTAMLRGRWGIEKMRGDGDLHHCKDAVVIAATSRSMIEDLTKYYQEEEQRFMGKTHFVDPATGEVLTRKEFPQPWPRFREELEARLDPIDPMEAVMALHLSTYEPEEEIAPVFVSHMPKHTVTGAAHEETIRSRTETGTVVKTALTSLKLDKNGGIEGYYNPQTDPRLYQALVERLRQFDGKGEKAFAEPFYKPKKDGTPGPRVDKVKIERKSSLSVSTGRGVADNGRMVRIDVFRVPDDGYYFVPIYVADTKKAVLPSKAVVAGKSPEAWKQMKPERFLFSLFKDDLIYVESRKGISLALAKEAVGEKTIQPKSGLFYFCGANISSGSIGIETDDRRYGKESLGLKTLTLIEKCQVDVLGNVSKVRLPEKRLEFRGRK

SEQ ID NO: 1535 - protein, 1058 aa, Unknown
  Description of Unknown: uncultivated organism with predicted taxonomy: Clostridiales bacterium 42_27
  MG21-25 effector
KAEQPKTGASLAAPRRDARSARRRLRRHRHRLERIHYLMEQRGIMPVADIQAMYAAGGFQKSPYQLRAEALDRPLIKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGVVWMDEDMETAYLSVLESQRRFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIATTTPGLVQRLTAYNKHRETWERPPAGYVDPATGELIELPQEARHDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1536 - protein, 1100 aa, Unknown
  Description of Unknown: uncultivated organism with predicted taxonomy: Ruminococcaceae bacterium TF06-43
  MG21-26 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTVIEENRRCMAEYGYRTVGEMMYRDERFWQKHPDGTRYHQTRNKAEDYRFTVERAAIVDEVRQIFAAQRKLGVVWMDEDMETTYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIATTTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGTKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1537 - protein, 1098 aa, Unknown
  Description of Unknown: uncultivated organism with predicted taxonomy: Clostridiales
  MG21-27 effector
LSLRYTLGLDIGIASVGWAVLENNIDGEPIKIERLGVRIFDKAEHPKTGASLAEPRREARGQRRTIRRKRHRKDRIKQLIQQNGIMTRVEMSEMFEHSQFETSVYELRVQALERALTKQEFVRVLIHLAQRRGYKSNSKSEEAKDKENGKVKSAISENKQCMEENGYRTIGEMLLHDDRFWECNPDGTKIFVPHNHLDDYRTTVERSMVEDEIRLIFSQQRALGVSYVTAEFEEAYLEIWGSQRNFDEGPGGKSPYGGNMIEKMLGHCTFEKDEPRAAKGSYSAEYFRLLQDVNHLRLVKNNGESSALTAEQKQIYIDLVMKSATASYAQLRKKLELSNDISFNMLRYGSDEIEKVERKKLGHMKFYHEMRKALNTVQKDAISTVSWEQRDEIARILLCYKSDDKRKAQLEKLDIPHEFIPALLTLSTSKTAHLSAKALRKLIPYLEKDMTYAEACKEVYGEHKSSITKKNKLSLFDIEPINNPVVRRAVSQTIRVINAVVREYGAPEVVRVELAREMGKPYDVRTQITKKQEANAKKNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVSRKQTHKISGAAHEATIRSAKKPGGSISKKTLTSLSLNKKTGEIEGYYAPESDRLLYEALKKRLEEFDGNAKEAFAEPFYKPKRDGTRGPLVKKVKIYEKKTITVPVNGGNADNGSMIRVDVFYMEDDGYYYVPIYTADVIKGKLPNKAVVQGKTFEDWKEMDDRDFLFSMYPSDLLYIESRRGIKLKTKKGSSWQEEIARKAGLYYFKGLNISSGNLFIITHDHSYEQSSLGGKTLSCLKKYTVDALGNYSEVSLPEKRKPLRG

SEQ ID NO: 1538 - protein, 1100 aa, Unknown
  Description of Unknown: uncultivated organism with predicted taxonomy: Clostridiales bacterium 42_27
  MG21-28 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1539 - protein, 1100 aa, Unknown
  Description of Unknown: uncultivated organism with predicted taxonomy: Firmicutes
  MG21-29 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGQSPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEIANPVVRRAVSQTIKVINAVVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGNDDVRWHEYEVRVENLIRNYRKRQKLLKRQLSEEESAGFIDRNLKDTQYITRAIYTLIRDNLVFAESNYKKRPVQTVNGAVTSMLRNRWGVQKIREDGDLHHCLDAAVIAATTPGLVQRLTEHSKRRETLEKAPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1540 - protein, 836 aa, Unknown
  Description of Unknown: uncultivated organism with predicted taxonomy: Clostridiales bacterium 42_27
  MG21-30 effector
RVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVARTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMIRIDVFYVEDDGYYFVPIYVADTKKESLPNKAAVAMKPYNLWKKMKDENFVFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1541 - protein, 1103 aa, Unknown
  Description of Unknown: uncultivated organism
  MG21-31 effector
MKKGQKHCHYTLGLDIGIASIGWAVLGNDEDGTPNRIIDLGVRIFDKAEVENTGESLAAPRRDARSARRRLRRHRHRLERIRYLLVQQGVLTQEEMTHLYDKSDMVSPYQLRTEGLDRLLNAREFSKVLIHLAQRRGYQSNSTAEEVKNEKENGIIKSAILENQQRMEQGGYRTIGEMMYRDAAFWETINGIRYHCTRNKAGDYRFTVDRASILAEVSIFFEAQRRLGSPWASVEMEDAYTGILSSQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGEDTIEKAEKRKWPQMQSYHKIRTALDKVSKNAIQTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVNAVVRIYGKPDAVRIELAREMHHSIKERNRMKKRQEENREKNEQVKAQILETKPGTRVTGLDIVKFKLYQEQDGICLYSGKPLEIERLYEPGYAEVDHIIPYSRCFDDSYSNKVLVLAEENQQKGNCTPYEYFGADEQRWHEFSVRVGASVRDFKKRQKLLNTSFGEEQGKDFIQRNLNDTQHITRVVYNYLRNNLEFADSAYAKAPVQAVNGAVTAMLRGRWGIEKMRGNGDLHHCKDAVVIAATSDSMIKDLTKYYQEEEQRFMGKTHFVDPATGEVLTRKEFPQPWPRFREELEARLDPTNPKEALMALNLSTYEFDPEEEIPPVFVSHMPKHTVTGAAHEETIRGKTETGTVVKTALTSLKLDKNGEIEGYYNPQTDPRLYQALVERLRQFDGKGEKAFAEPFYKPKKDGTPGPRVDKVKIERKSSLSVSTGRGVAKNGDMIRMDVFRIPNERKPDDSYYFVPIYVADTKKRILPSRAVVRGKLPEEWKQMKPEHFLFSLFKGDLIYVESKKEISLALAKEAVGEKTIQVKSGLFYFCGANISNGSIEIETHDRRYGKEGLGIKKLKVFEKRQVEVLGEVRKVKLPEKRLEFRGRK

SEQ ID NO: 1542 - protein, 1100 aa, Unknown
  Description of Unknown: uncultivated organism with predicted taxonomy: Ruminococcaceae bacterium TF06-43
  MG21-32 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVQVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNLLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPASYVDPATGDLLELPQEARRDLFPKPWERFRQELEARLNPIDPRHQIDLLKLSTYESDEEIKPVFVSRMPNHKVTGAAHAETIRSRKGGDGFTVTKTPLTNLKLNKFGEIEGYYNPASDTLLYNALLSRLKDFGGDGAKAFAKPFYKPKKDGTPGPRVDKVKICEKATIGLPVRNGIAANGSMIRIDVFYVEDDGYYFVPIYVADTKKERLPNKAVVAYKAYSEWKEMKDENFIFSLYPGDLVRIQSRKGIKLTLTKGGTGEPEIVRQQGMYYYQTANISSGAVTISTHDRRYSQSSLGIKTLQSIEKYQVDVLGNYYKVDLPEKRMTFSKEG

SEQ ID NO: 1543 - protein, 1097 aa, Unknown
  Description of Unknown: uncultivated organism with predicted taxonomy: Clostridiales
  MG21-33 effector
LSLRYTLGLDIGIASVGWAVLENNIDGEPIKIERLGVRIFDKAEQPKTGASLAEPRREARGQRRTIRRRRHRKDRIKQLIQQNDIMTRVEMAEMFEHSQFETSVYELRVQALERALTKQEFVRVLIHLAQRRGYKSNSKSEEAKDKENGKVKSAISENKKCMEENGYRTIGEMLLNDDRFWEYNPDGTKIFVPHNHPDDYRTTVERSMVEDEIRLIFSRQHALGVPYATSEFEEAYLEIWGSQRNFDEGPGGKSPYGGNMIEKMLGHCTFEKDEPRAAKGSYSAEYFRLLQDVNHLRLVKNNGESCALTREQKQIYIDLVMKSAAASYAQLRKKLGLSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSAKALRKLIPHLEKGMTYAEACKEVYGEQKSSITKKNKLSLFDIEPINNPVVRRAVSQTIRVINAVVREYGAPEVVRVELAREMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPSMIQKITQYTKHRECIRKTKEGYLDTETGELMTREAYDAKYSPRFPAPWERFRQELEARLSDNPAEEIARLHLATYDSEEEIKPVFVSRKQTHKISGAAHEATLHRKADGGYINKVSLTKLTLDKKTGEIKNYYAPESDRLLYEALKKRLKEFDGNAKEAFAEPFYKPKRDGTRGPLVKKVKLYEKKTITVPVGGGNADNGSMIRVDVFYIEDDGYYYVPIYTADVIKGALPNRAVVADKSHGEWKVMNDKDFLFSMYPNDLLYIESRKGIKLKTKKGSSKQEQIVRKTGLYYFKGLNISSNALSIITHDHSYEQSSLGGKTLSCLKKYTVDALGNYSEVSLPEKRKPLRG

SEQ ID NO: 1544 - protein, 1100 aa, Unknown
  Description of Unknown: uncultivated organism with predicted taxonomy: Clostridiales
  MG21-34 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVCIQSRKGIKLNLAKGGTGEKEIVRQEGMYYYRAAGITVGAIQIETHDRRYLQPSLGIKTLQSIEKYQVDVLGNYQKVDLPEKRMTFSKEG

SEQ ID NO: 1545 - protein, 1100 aa, Unknown
  Description of Unknown: uncultivated organism with predicted taxonomy: Clostridiales
  MG21-35 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMDEITNPVVRRAVSQTIKVINAVVRTYGPPDVVRIELAREMSRTFDERRKMEKRQDDNRAANERAKNQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFVQPFYKPKKDGSPGPRVDKVKICEKATVGLPVRDGIAANGSMVRIDVFYVEDDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1546 - protein, 1127 aa, Unknown
  Description of Unknown: uncultivated organism
  MG21-36 effector
MNYRIGLDLGIASVGWAVLEDDYMGKPKRIVKLGARIFDSAENPKDGSSLALNRREARETRRRLRRRNHRIKRTKNLLEKYNIMTTKEIEDMYATYKFQFNPYELRVKGLDEKLTNSELSRILISFVKRRGYKSNSKSEETNDKEMGKLLTATKENELLMKEKGYRTVGEMYLKDEKFKMQMPDGRILLKVRNTTDDYKNTPLRKLLLDEIKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKTKVTLTYASLRIALNLAGNERFNMIHYKATNVFSDEINKEAEKERKFKEFESYHKMRVSMDKAEKNYILKLSTDELDVIGTVLTLYKNDNKRIEKLAQLNLPENIINEMLKLSFSKVGNLSIKAMKKIIPYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNKIPYQYMQEKGRDLDEYEIRVNNIIKNYSKKQRLLKQKFTREDANEWKDRNIQDTQYISRLMYNLIKNHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKPYAEWKEMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 1547 - protein, 1100 aa, Unknown
  Description of Unknown: uncultivated organism with predicted taxonomy: Clostridiales
  MG21-37 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTAIEENRRCMAEYGYRTVGEMMYRDERFWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARHDQFPKPWERFRQELEARLDPIDPRHQIDLLKLETYESDEEIQPVFVSRMPNHKVTGAAHAETIRSSKGGDGFTVTKTPLTNLKLNKFGEIEGYYNPESDKLLYDALLARLKAFGGDGAKAFDQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1548 - protein, 1100 aa, Unknown
  Description of Unknown: uncultivated organism with predicted taxonomy: Clostridiales bacterium 42_27
  MG21-38 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEDMETAYLSILESQRSFDEGPGGDSPFFGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1549 - protein, 1100 aa, Unknown
  Description of Unknown: uncultivated organism with predicted taxonomy: Clostridiales
  MG21-39 effector
MSEFHYALGLDIGIGSVGWAVLRNQTNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLSEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLNPIDPRHQIDLLKLSTYESDEEIKPVFVSRMPNHKVTGAAHAETIRSRKGGDGFTVTKTPLTNLKLNKFGEIEGYYNPASDTLLYNALLSRLKDFGGDGAKAFAKPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1550 - protein, 1100 aa, Unknown
  Description of Unknown: uncultivated organism with predicted taxonomy: Clostridiales
  MG21-40 effector
MSDFHYALGLDIGIGSVGWAVLRNRPDGEPDRIQDLGVRIFDKAEQPKTGASLAAPRREARSARRRLRRHRHRLERIRYLMEQHGIMPISDIQAMYAAGGFEKSPYQLRAEALDRPLSREELVRVLIHLAQRRGYRSNSTAEAAKNEKETGKVKSAIEENRACMEQHGYRTVGEMMFRDERFWQNNPDGTRCHQTRNKAEDYRFTVERTAIVDEAKQIFTAQRRFGADWMDDGLEAAYLAVLESQRSFDEGPGGDSPFHGGIGERVGFCTFEPDEQRAAKATYTFEYFKLLQDLNHMRLAGNGTAPQPLNAQQREILKAAALQSASLSYGQIRKKLALDENVFFHHLYYGDKPKEEAEKRKWPQMQSYHKMRTALDKVGKGTINTLTETQLNAIATILTQYKSDARRIEALREAGIPAQFDDALLPLSFSKYGNLSVTAMQKLIPLLEQGMRYDEACTQIYGDHRGLHPEQRKNRLSLRDMREITNPVVRRAVSQTIKVVNAVVRTYGPPDVVRIELAREMSQNFEKRRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDEARWHGYEVRVENLIRNYRKRQKLLKKRLTEEESAGFIDRNLKDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPQHQIDLLKLATYESDEEIRPVFVSRMPNHKVTGAAHAETIRSSKGGDGFTVTKTPLANLKLNKFGEIEGYYNPASDTLLYNALLARLKDFGGDGAKAFAQPFYKPKKDGTPGPRVDKVKICEKATIGLPVRNGIAANGSMIRIDVFYVEDDGYYFVPIYVADTKKAELPNKAVVAYKAYSDWKEMIDENFLFSLYPGDLVRIQSRKGIKLNIAKGGTGEKEIVRQDGLYYYQGANIATGAIALATHDRRYLQSGLGLKTLQSIEKYQVDVLGNYYKVDLPEKRMKFSKEG

SEQ ID NO: 1551 - protein, 1102 aa, Unknown
  Description of Unknown: uncultivated organism with predicted taxonomy: Firmicutes
  MG21-41 effector
MKKGQKHCHYTLGLDIGIASIGWAVLGNDEDGTPNRIIDLGVRIFESAEVQKTGESLAAPRRDARSARRRLRRHRHRLERIRYLLVQQGVLTQEEMTHLYDKSDTVSPYQLRTEGLDRLLNAREFSKVLIHLAQRRGYQSNSTAEEAKNEKENGIIKSAILENQQRMERGGYRTIGEMMYRDAAFWETINGIRYHCTRNKAGDYRFTVDRASILAEVSILFEAQRRLGAPWASVEMEDAYTAILSGQRSFDEGPGGDSPFRKGISDRVGYCTLEPTEQRAAKADATFEYFKLLQDLNHMRLVDNSGSHPLTQQQRALLEEMAFRSANLTYGQLRKKLGLLDEVRFAGLYYGEDTIEKAEKRKWAQMQSYHKIRTALDKVSKDAISMFDKDQLDAIGEILTAYKADAARIEHLQTAGIQKEYHKALLSLSFSKYGKLSCCAMRKLIPFLQQGMRYDEACREVYQDHRTKEASEKKQRLSLNDIDEITNPVVRRAVSQTIKVVNAVVRTYGNPDAVRIELAREMSHSFDERNKMKKRQEDGWQKNEQVKAQILETKTGTRVTGLDIVKFKLYQEQDGICLYSGTPMEIERLYEPGYADVDHIIPYSRCFDDSYSNKVLVLASENRQKGNRTPYEYFGANEQRWHEFSVRVGASVRDFKKRQKLLNTSFGEEQGKEFIQRNLNDTQHITRVVYNYLRNNLEFADSAYAKAPVQAVNGAVTAMLRGRWGIEKMRGDGDLHHCKDAVVIAATSRSMVQRLTNYYKEEERLFMGKTHFVDPATGEVLTRKEFQQRFAPKFPQPWDRFREELEARLDPIDPMEAVMALHLSTYEPEEEIAPVFVSHMPKHTVTGAAHEETIRSRTETGTVVKTALTSLKLDKNGEIEGYYNPQTDPRLYQALVERLKKFGGDGAKAFAEPFYKPKKDGTPGPRVDKVKIERKSSLSVSTGRGVADNGRMVRIDVFRIPDDGYYFVPIYVADTKKATLPSKAVVAGKSPEAWKQMKPEHFLFSLFKGDLIYVESRKGISLALAEKATGEKTIQVKSGLFYFCGADISTGSIGMEIHDRRYTKRGLGIKTLTLIEKCQVDVLGNVSKVRLPETRLEFRGRK

SEQ ID NO: 1552 - protein, 818 aa, Unknown
  Description of Unknown: uncultivated organism with predicted taxonomy: Clostridiales
  MG21-42 effector
EKRELTSEEKEKLKELVFSKVTVTYSDVRKTLQLESNQRFNMFTYRDLLNYTEETNKEIEKEKKLKEFESYKKIKTALNHIEKNYITKLTTDDLDEIGYALTVYKSNDKRKEYLEKHTPNLSKEAIEELLKLSFSKVGNLSLKAMKKIIPELEKEVTYDKAVDKVYEDFRGTVDTQKKRKLSLKDFEQEISNPVVRRGLSQAIKVLNAITLRYNEKFGKPDVVVVELARELGKNFADRRTIEKRQSDNTQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNSKKKQNLLRQDFTREDAEDWKERNLNDTKYICKYMYNLIRNHLEFSDNANFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECLESEKIYTYEDYDDVEPIFVSRMPRRKVTGPAHVATIRGIKEKDGELKTITKTELTKLKLKDGEIEGYPENCRRDDRLLYEALKNRLIEFNGDAVKAFSEPFYKPKSDGTRGPIVNKVKIEANTTMGVTLNDKKAFAANGDCVRLDIFYVENEGYYFIPIYVSDTVKKELPNKACVSGKKYADWKEMKDENFIFSIYPKDLIYIQGKNKIKLNPVIKDKDSIEVEDIFAYYIKAGISSAVITIQTNEGKYVQPSLGIKSLKKLEKYEVDILGNYHKVKLPEKRLPFNINKK

SEQ ID NO: 1553 - protein, 843 aa, Unknown
  Description of Unknown: uncultivated organism with predicted taxonomy: Clostridiales bacterium 42_27
  MG21-43 effector
FSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANKRAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHPCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRGSDISTGAISVSSHDRRYESRGIGVKTLQSIEKYQVDVLGNYYKVDLPEKRMTFSKEG

SEQ ID NO: 1554 - protein, 1128 aa, Unknown
  Description of Unknown: uncultivated organism with predicted taxonomy: Clostridiales
  MG21-44 effector
MNYRIGLDLGIASVGWAILEDDNKGNPKRIVKLGSRIFDAAENPKDGSSLALNRREARNTRRRLRRRNHRIKRTKNLLEKYNIITIKEIENMYATYKFQFNPYELRVKGLDEKLTNSELARVLISFVKRRGYKSNSKAEETSNKEMGKLLVATKENEILMKEKNYRTIGEMYLKDEKFKIQMPDGRVLLKVRNTTDEYKNTPLRKLLLDEIKQILEKQKELNSNITDSFIDEYINIFTSQRNFDDGPSQPSIYAGNQIEKMLGKCTFEKEENRSAKATYTFEYFKLLQDINHIKIEEYHLKENGTREVIKRTLTEEERNIIINLAKTKVTLTYDSLRTALKLTTNERFNMINYKRTDIFNDEENKKVEKDRRIKEFESYHKIRVAMDRIEKNYINKLNSDDLDTIGTVLTLYKNDNKRIEKLKEINLPEDIVNELLKLSFSKVGNLSIKAMKKIIPYLEQGYTYDKAVNEVYEDFRGIINTKKKKKIALRDLEQELSNPVVKRAVSQAIKVLNAITTTYGKPDIINIELARQLSKKFADRQNIKKKQEQNMQNNDKAREEILKLGKNNPTGQDIVKYKLWQEQDGICVYSGKHISIEDLFTEAVDVDHIIPYSMCFDDTYKNKVLVLASENRQKGNRIPYQYLKEKGRNLEEYEVRVNNIIKNYYKKKRLLRQNFTREDATEWKDRNIQDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAEKIYYENYDDVKPVFISRMPRRKVTGQAHLDTIRGIRKNEEGIKTLTKTELTKLKLDKNGEIEKYPDSQKQDDKLLYKALVDQLRKFGGNGEEAFKRPFYKPKSDGTPGPLVKKVKLEDKTTLAVELNNGKAIAANGDMIRIDVFKVDGEGYYFVPIYVSDTIKSKLPNKACVAAKQYSEWKDMKDENFIFSLYPRDLIYIKSKNKIKLTSINKENKETKEISEMFAYYIKSGISTAAISIINHNGEYEQNSLGIKTLKEFKKFEVDVLGNYHEVKLPEKRQSFKNLKKKGGSLK

SEQ ID NO: 1555 - protein, 1100 aa, Unknown
  Description of Unknown: uncultivated organism with predicted taxonomy: Clostridiales
  MG21-45 effector
MSEFHYALGLDIGIGSVGWAVLRNQPYGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTAIEENRRCMAEYGYRTVGEMMYRDERFWQKHPDGTRYHQTRNKAEDYRFTVERAAIVDEVRQIFAAQRRLGVVWMDEDMETAYLSVLESQRSFDEGPGGDSPFSGGIGKRVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVARTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMIRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1556 - protein, 818 aa, Unknown; identical to SEQ ID NO: 1552
  Description of Unknown: uncultivated organism with predicted taxonomy: Clostridiales
  MG21-46 effector

SEQ ID NO: 1557 - protein, 1098 aa, Unknown; identical to SEQ ID NO: 1537
  Description of Unknown: uncultivated organism with predicted taxonomy: Clostridiales
  MG21-47 effector

SEQ ID NO: 1558 - protein, 848 aa, Unknown
  Description of Unknown: uncultivated organism with predicted taxonomy: Clostridiales bacterium 42_27
  MG21-48 effector
LMEQRGIMPVADIQAMYAAGGFQKSPYQLRAEALDRPLIKEEAVRVLIHLAQRRGYKSNSTAEAAKDEKETGKVKTAIEENRRCMAEHGYRTVGEMMFRDERVWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARHDQFPKPWERFRQELEARLDPIDPRHQIDLLKLETYESDEEIQPVFVSRMPNHKVTGAAHAETIRSSKGGDGFTVTKTPLTNLKLNKFGEIEGYYNPESDKLLYDALLARLKAFGGDGAKAFDQPFYKPKKDGTPGPRVDK

SEQ ID NO: 1559 - protein, 1100 aa, Unknown
  Description of Unknown: uncultivated organism with predicted taxonomy: Clostridiales bacterium 42_27
  MG21-49 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1560 - protein, 1100 aa, Unknown; identical to SEQ ID NO: 1538
  Description of Unknown: uncultivated organism with predicted taxonomy: Clostridiales bacterium 42_27
  MG21-50 effector

SEQ ID NO: 1561 - protein, 983 aa, Unknown
  Description of Unknown: uncultivated organism with predicted taxonomy: Clostridiales bacterium 42_27
  MG21-51 effector
MSEFHYALGLDIGIGSVGWAVLRNQPNGEPDRIQDLGVRIFDKAEQPKTGASLAAPRRDARSARRRLRRHRHRLERIRYLMEQRGIMSVSDIQAMYAAGGFQKSPYQLRAEALDRPLSKEEAVRVLIHLAQRRGYKSNSTAEAAKDEKETGKVKTAIEENHRCMAEHGYRTVGEMMYRDERFWQKHPDGTRYHQTRNKAEDYRFTVERAAIVDEVRQIFAAQRRLGTAWMDEDMETAYLSILESQRSFDEGPGGDSPFSGGIGERVGACTFEPDEKRAAKATYTFEYFKLLQDLSRMRLTGMGMPPEPLDDEQREVLKSAALRSASLSYGQIRKKLNLDDDVFFHGLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDVACTRVYGDHRGLRPGQRTNRLSLKDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIREHLVFAESAYRKKPVQTVNGAVTSMLRGRWGVQKIREDGDLHHCLDAAVIAATTPGLVQRLTAYNKRRESWERSPAGYVDPATGELIVLPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKAFGGDGAKAFAQPFYKPKKDGTPGPRVDKVKICEKATVGLPVRDGIAANGSMVRIDVFYVEDDGYYFVPIYVADTKKESLPNKAA

SEQ ID NO: 1562 - protein, 1026 aa, Unknown
  Description of Unknown: uncultivated organism with predicted taxonomy: Clostridiales bacterium 42_27
  MG21-52 effector
ERIRYLMEQRGIMPVADIQAMYAAGGFQKSPYQLRAEALDRPLTKEEAVRVLIHLAQRRGYKSNSTAETAKDEKETGKVKTAIEENRRCMAEHSYRTVGEMMYRDERFWQKHPDGTRYHQTRNKAEDYRFTVERAAIVDEARQIFAAQRRLGTVWMDEDMETAYLSILESQRSFDEGPGGDSPFSGGIGERVGACTFEPDEKRAAKATYTFEYFKLLQDLNRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIQPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGNMVRIDVFYVEDDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1563 - protein, 1097 aa, Unknown
  Description of Unknown: uncultivated organism with predicted taxonomy: Clostridiales
  MG21-53 effector
LSLRYTLGLDIGIASVGWAVLENNIDGEPIKIERLGVRIFDKAEETDGSPLAKHRREARGQRRTIRRKRHRKDRIKQLIQQNGIMTRVEMSEMFEHSQFETSVYELRVQALERTLTKQEFVRVLIHLAQRRGYKSNSKSEEAKDKENGKVKSAISENKQCMEENGYRTIGEMLLNDDRFWECNPDGTKIFVPHNHLDDYRTTVERSMVEDEIRLIFSQQRALGVSYATAEFEEAYLEIWGSQRNFDEGPGGKSPYGGNMIEKMLGHCTFEKDEPRAAKGSYSAEYFRLLQDVNHLRLVKNNGESSALTAEQKQIYIDLVMKSAAASYAQLRKKLELSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSAKSLRKLIPYLEKGMTYAEACKEVYGEHKSSITKKNKLSLFDIELINNPVVRRAVSQTIRVINAVVREYGAPEVVRVELAREMGKPYDVRTQITKKQEANAKKNEELRQQIKKIKGAEPTGQDIVKFKLFQEQKGVCLYSGQNLDITRLFEAGYVDVDHIVPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVSRKPERKTTGAAHEATIRSAKKPGGSISKKPLTSLSLNKKTGEIEKYYAPESDRLLYEALKKRLEEFDGNAKEAFAKPFYKPKRDGTRGPLVKKVKLYEKKTITVPVNGGNADNGRMIRVDVFYMEDDGYYYVPIYITDVVKDELPNKAVVQKKLPEDWKEMDDRDFLFSMYPNDLIYVERKEVFELTAPKGSSLDPTISKTKGFFYYRSFDSNTGSFKIYTHDSSYSKKSLGGKTLSCLKKYTVDVLGNYSEVSLPEKRKPLRG

SEQ ID NO: 1564 - protein, 1100 aa, Unknown
  Description of Unknown: uncultivated organism with predicted taxonomy: Clostridiales
  MG21-54 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDHPLSKEEAVRVLIHLAQRRGYKSNSTAEAAKDEKETGKVKTAIEENRRCMAEHGYRTVGEMMFRDERFWQKHPDGTRYHQTRNKAEDYRFTVERAAIVDEVRQIFAAQRRLGVVWMDEDMEIAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNNLYYGEKTKEEAEKRKWPQMQSYHKLRTALDKVGKGAIGTLTEEQLNAVATILTEYKSDAKRIAALREAGIPPQFDEALLPLSFSKYGSLSVRAMQKLIPLLEEGLRYDGACTRVYGDHRGLRPGQRTNRLSLKDMEEITNPVVRRAVSQTIKVINAVVRTYGPPDVVRIELAREMSRTFDERRKMEKRQDDNRAANERAKDQISEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRTVYNLIRDHLAFAESAYRKKPVQAVNGAVTAMLRGRWGVQKIREDGDLHHCLDAAVIAATTPGLVQRLTAYNKHRETWERPPAGYVDPVTGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKIREKATVGLPVRNGIAANGSMVRIDIFYVEDDGYYFVPIYVADTKKDRLPSKAPVAHKAYSAWKEMRNENFIFSLYPGDLVRIQSRAGIKLSLAKDGTGEKEIVRQNGLYYYRSADIEGGKIDIEAHDRRYSKHGLGLKTLQSIEKYQVDVLGNYYKVDLPEKRMTFSKEG

SEQ ID NO: 1565 - protein, 986 aa, Unknown
  Description of Unknown: uncultivated organism with predicted taxonomy: Ruminococcaceae bacterium TF06-43
  MG21-55 effector
LLNAREFSKVLIHLAQRRGYQSNSTAEEAKNEKENGIIKSAILENQQRMEQGGYRTIGEMMYRDAAFWETINGIRYHCTRNKAGDYRFTVDRASILSEVSLLFEAQRRLGSPWASVEMEDAYTAILASQRSFDEGPGNDSHGNESPFRKAMSHNVGNCTLIPTEPRAARADYTAEYFKLLQDLNHMRLVDNSGSHPLTQQQRAILEEMAFRSANLTYGQLRKKLGISDEVRFAGLYYGQDTIEKAEKRKWPQMQSYHKIRTALDKVSKDAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVNAVVREYGNPDAVRIELAREMHHSIKERNRMKKRQEENREKNEQVKAQILETKPGTRVTGLDIVKFKLYQEQDGICLYSGKPMEIERLYEPGYAEVDHIIPYSRCFDDSYSNKVLVLAKENQQKGNCTPYEYFGADEQRWHEFSARVRASVRDFKKRQKLLNTSFGEEQGKEFIQRNLNDTQHITRVVYNFLRNNLEFADSAYAKAPVQAVNGAVTAMLRGRWGIEKMRGNGDLHHCKDAVVIAATSDSMIEDLTDYYKEEERLFMGKTHFVDPATGEALTRKEFQQRFAPQFPQPWPRFREELEARLDPIDPMEAVMALHLSTYEPDEEIAPVFVSHMPKHTVTGAAHEETIRGKTETGTVVKTALTSLKLDKNGEIDGYYNPQTDPRLYQALVERLKKFGGDGARAFAEPFYKPKKDGTPGPRVDKVKIKSKSSLSVPTGRGVAKNGDMIRMDVFHVPDDGYYFVPIYVADTKKAILPSKAVVAGKSPEAWKQMKPEHFLFSVFKGDLIYVESKTEISLALAKNAVGEKTIQVKSDLFYFCGADISNGSIKIKTHDRRYEQKKLGIKKLEVLEKYQVDVLGNVSKVKLPETRLEFRGRK

SEQ ID NO: 1566 - protein, 1046 aa, Unknown
  Description of Unknown: uncultivated organism with predicted taxonomy: Clostridiales bacterium 42_27
  MG21-56 effector
PPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDPLTAETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1567 - protein, 1098 aa, Unknown
  Description of Unknown: uncultivated organism
  MG21-57 effector
MTSQAIRYTLGLDIGIASVGWAVLKNGSDGEPYKIENLGVRIFDKAEVPKTGASLAAPRREARSSRRVVRRRRHRKERIKYLIEQEGIMTQTEMMQLFQNSSFEKSVYEIRVEALDRLLTREEAVRLLIHFAQRRGYKSNSKAEEAKDNENGVIKQAISQNKQVMKAHGYRTFGEMLLMDDRFYYTQPDGARIFIPHNKASDYKVTAERGMLADELHMIFAAQRSLGSLWFSDTFETAYMEVWSSQRSFDEGPGGNSQYGGNQIEKMLGKCFDGELRAPKASYSAEYFRLLQDINHLRIVSLDGASSPLTQEQRDIVVAASKKSGTLTYTQLRKKLALADDQYFNALYYGDKTTAEIEKKKFGHLQFYHQLRTVLDKVEKGAADTLTWEQRDEIARILTVYKADDRRTDELQKAGIPEKYIDALLPLSPTKAMHLSITAIKKIIPYLEAGMPYSDALSKAYGNQTNASTSSKKHKLSLSDIEEITNPVVRRAVSQSIKVINAIVRQYGAPERVRIELAREMGKNFKDRRMIETRQTDNAAKNERIKAQISEYKSDHITGQDIVKFKLFKEQDGICLYSGKSLNIARLFEPGYVDIDHIIPYSISFDDSYNNKVLVLSSENRQKGNRIPYAYFGQNSDRWEKYETLVNNTVRSYRKRKNLLLKSLSEAQIDGFKQRNLQDTQYLSKVVFRLIEDHLQFAETAPGKKHTQPVNGAITAQVRKRLGIEKIREDGDLHHAMDAAVIACITPGMIQRITKYAQNHERFYATAKGYADIKTGEVLTRAQYEAMDDIRFPEPWAGFRLELEARVSDHPQEAIAQLKLPHYENSEEIRPIFVSRMPNHKVTGAAHLETIRSKKGGAGSTVTKTALTELKLGKDGEIAGYCRKEDDPLLYEALKARLKAFGGDGKKAFAEPFHKPKHNGEPGPIVNKVKIQESATLTVPVNHGVAANGSMVRLDVFYVDGDGYYFVPIYTADIVKPKLPNRAVVAGKKASEWKMIDDNHFVFSLYPKDLLRIRSNKGIKLKAVNKNADLQEYSANDCLCYYVGFDIATGAFTVESHDRRFNRRGLGGKTLLSIEKYQVDVLGNYFPVALPEKRMKFR

SEQ ID NO: 1568 - protein, 1100 aa, Unknown
  Description of Unknown: uncultivated organism with predicted taxonomy: Oscillibacter sp. CAG:241_62_21
  MG21-58 effector
MLEFHYALGLDIGIGSVGWAVLRNQENGEPDRIQDLGVRIFDKAEQSKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADNYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPEKRMTFSEEG

SEQ ID NO: 1569 - protein, 1100 aa, Unknown
  Description of Unknown: uncultivated organism with predicted taxonomy: Clostridiales
  MG21-59 effector
MLEFHYALGLDIGIGSVVWAVLRNQENGEPDRIQDLGVRIFDKAEQPKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADDYRFTVERAAIVDEAKRIFAAQSSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPENRMTFSKEG

SEQ ID NO: 1570 - protein, 1100 aa, Unknown; identical to SEQ ID NO: 1538
  Description of Unknown: uncultivated organism with predicted taxonomy: Firmicutes
  MG21-60 effector

SEQ ID NO: 1571 - protein, 1100 aa, Unknown; identical to SEQ ID NO: 1544
  Description of Unknown: uncultivated organism with predicted taxonomy: Clostridiales
  MG21-61 effector

SEQ ID NO: 1572 - protein, 1100 aa, Unknown
  Description of Unknown: uncultivated organism with predicted taxonomy: Firmicutes bacterium CAG:129
  MG21-62 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTAIEENRRCMAEYGYRTVGEMMYRDERFWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALMEAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARHDQFPKPWERFRQELEARLDPIDPRHQIDLLKLETYESDEEIQPVFVSRMPNHKVTGAAHAETIRSSKGGDGFTVTKTPLTNLKLNKFGEIEGYYNPESDKLLYDALLARLKAFGGDGAKAFDQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1573 - protein, 1100 aa, Unknown
  Description of Unknown: uncultivated organism with predicted taxonomy: Clostridiales
  MG21-63 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLELETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1574 - protein, 1100 aa, Unknown
  Description of Unknown: uncultivated organism with predicted taxonomy: Clostridiales
  MG21-64 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1575 - protein, 833 aa, Unknown
  Description of Unknown: uncultivated organism with predicted taxonomy: Clostridiales bacterium 42_27
  MG21-65 effector
LSLRYTLGLDIGIASVGWAVLENNIDGEPIKIERLGVRIFDKAEETDGSPLAKHRREARGQRRTIRRKRHRKDRIKQLIQQNGIMTRVEMSEMFEHSQFETSVYELRVQALERALTKQEFVRVLIHLAQRRGYKSNSKSEEAKDKENGKVKSAISENKQCMEENGYRTIGEMLLNDDRFWECNPDGTKIFVPHNHLDDYRTTVERSMVEDEIRLIFSQQRALGVSYVTAEFEEAYLEIWGSQRNFDEGPGGKSPYGGNMIEKMLGHCTFEKDEPRAAKGSYSAEYFRLLQDVNHLRLVKNNGESSALTAEQKQIYIDLVMKSATASYAQLRKKLELSNDISFNMLRYGSDEIGKVERKKLGHMKFYHEMRKALNTVQKDAISTVSWEQRDEIARILLCYKSDDKRKAQLEKLDIPHEFIPALLTLSTSKTAHLSAKALRKLIPYLEKDMTYAEACKEVYGEHKSSITKKNKLSLFDIELINNPVVRRAVSQTIRVINAVVREYGAPEVVRVELAREMGKPYDVRTQITKKQEANAKKNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVS

SEQ ID NO: 1576 - protein, 1100 aa, Unknown; identical to SEQ ID NO: 1574
  Description of Unknown: uncultivated organism with predicted taxonomy: Clostridiales
  MG21-66 effector

SEQ ID NO: 1577 - protein, 1100 aa, Unknown; identical to SEQ ID NO: 1539
  Description of Unknown: uncultivated organism with predicted taxonomy: Clostridia
  MG21-67 effector

SEQ ID NO: 1578 - protein, 1100 aa, Unknown
  Description of Unknown: uncultivated organism with predicted taxonomy: Clostridiales
  MG21-68 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1579 - protein, 1109 aa, Unknown
  Description of Unknown: uncultivated organism with predicted taxonomy: Firmicutes
  MG21-69 effector
MKKGQKHCHYTLGLDIGIASIGWAVLGNDEDGTPNRIIDLGVRIFESAEVQKTGESLAAPRRDARSARRRLRRHRHRLERIRYLLVQQGVLTQEEMTHLYDKSDMVSPYQLRTEGLDRLLNAQEFSKVLIHLAQRRGYQSNSTAEEAKNEKENGIIKTAILENQQRMERGGYRTIGEMMYRDAAFWETINGIRYHCTRNKAGDYRFTVDRASILAEVSILFEAQRRLGSPWASVEMEDAYTAILSGQRSFDEGPGNDSHGNESPFRKAMSHNVGNCTLIPTELRAARADYTAEYFKLLQDLNHMRLMDNSGSHPLTQQQRAILEEMAFRSANLTYGQLRKKLGLSDEVRFAGLYYGEDTIEKAEKRKWAQMQSYHKIRTALDKVSKNAIQTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDNYSNRKEMKLDAVRIELAREMHHSIKERNRMKKRQEENREKNEQVKAQILETKPGTRVTGLDIVKFKLHQEQKGFCPYSGVEIKKERLYEPGYAEVDHIIPYSRCFDDSYSNKVLVLAEENRQKGNRTPYEYFGADEQRWHEFSARVRASVQDFKKRQKLLNTSFGEEQKNEFTQRNLNDTQHITRVVYNYLRNNLEFADSAYAKAPVRAVNGAVTAMLRGRWGIEKMRGNGDLHHCKDAVVIAATSRSMVQRLTNYYKEEERLFMGKTNFVDPATGEVLTRKEFQQRFAPKFPQPWDRFREELEARLDPIDPMEAVTALYLSTYEPEEEIAPVFVSHMPKHTVTGAAHEETIRSRTETGTVVKTALTSLKLDKNGEIDGYYNPQTDPRLYQALVERLRQFDGEGKKAFAEPFYKPKKDGTPGPRVDKVKIERKSSLSVSTGRGVADNGRMVRIDVFRVPDDGYYFVPIYVADTKKGILPSKAVVAGKSPEAWKQMKPEHFLFSLFKGDLIYVESRKGISLALAEKATGEKTIQVKSGLFYFCGADISTGSIGMEIHDRRYTKRGLGIKTLTLIEKCQVDVLGNVSKVRLPETRLEFRGRK

SEQ ID NO: 1580 - protein, 1117 aa, Unknown
  Description of Unknown: uncultivated organism with predicted taxonomy: Firmicutes
  MG21-70 effector
MKKRKKKKKDKKDCHYTLGLDIGIASIGWAVLGNDEDGKPNRIIDLGVRIFDKAEVENTGESLAAPRRDARSARRRLRRHRHRLERIRYLLVQQGVLTQEEMTHLYDKNDMVSPYQLRTEGLDRLLNAREFSKVLIHLAQRRGYQSNSTAEEAKNEKENGIIKSAILENQQRMERGGYRTIGEMMYRDAAFWETINGIRYHCTRNKAGDYRFTVDRASILSEVSILFEAQRRLGSPWASVEMEDAYTAILSSQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGQDTIEKAEKRKWAQMQSYHKIRTALDKVSKDAIQTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVNAVVRIYGKPDAVRIELAREMSHSFDERNKMKKRQEDGWRKNEQVKAQILETKTGNRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNLNDTQHITRVVYNYLRNNLEFADSAYAKAPVRAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHTVTGAAHKETIRGKTETGTVVKTALTSLKLDKNGEIDGYYSPQTDPRIYQALVERLRQFNGKGEKAFAEPFYKPKKDGTPGPRVDKVKIERKSSLSVSTGRGVADNGRMVRMDVFRVPNERKPDDSYYFVPIYVADTKKGILPSKAVVAHKSPENWKQMKPEHFLFSLFKGDLIYVENSKGISLALAKEAVGEKTIQVKSGLFYFCGADISDGSIKIETHDRCYYKKSLGLKELDTVEKRQVEVLGEVRKVKLPEKRLEFRGRK

SEQ ID NO: 1581 - protein, 1107 aa, Unknown; identical to SEQ ID NO: 1534
  Description of Unknown: uncultivated organism with predicted taxonomy: Clostridiales
  MG21-71 effector

SEQ ID NO: 1582 - protein, 977 aa, Unknown
  Description of Unknown: uncultivated organism
  MG21-72 effector
VLIHLAQRRGYQSNSTAEEAKNEKENGIIKSAILENQQRMERGGYRTIGEMMYRDAAFWETINGIRYHCTRNKAGDYRFTVDRASILSEVSILFEAQRRLGSPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGEDTIEKAEKRKWPQMQSYHKIRTALDKVSKNAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDTYSKREEMKLDAVRIELAREMHHSIKERNRMKKRQEENREKNEQVKAQILETKPGTRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNLNDTQHITRVVYNYLRNNLEFADSAYAKAPVQAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHTVTGAAHKETIRGKTETGTVVKTALTSLKLDKNGEIDGYYNPQTDPRLYQALVERLRQFDGEGKKAFAEPFYKPKKDGTPGPRVDKVKIAEKASLSVSTGRGVADNGEMIRMDVFRVPNERKPDDSYYFVPIYVADTKKGILPWKQMKPEHFLFSIFKGDLIYVESKKEISLALAKEAVGEKTIQVKSGLFYFCGANISNGSIEIETHDRRYGKEGLGIKKLKVFEKRQVEVLGEVKKVKLPEKRLEFRGRK

SEQ ID NO: 1583 - protein, 1100 aa, Unknown
  Description of Unknown: uncultivated organism with predicted taxonomy: Clostridiales
  MG21-73 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIASLRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNLLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1584 - protein, 1097 aa, Unknown
  Description of Unknown: uncultivated organism with predicted taxonomy: Firmicutes
  MG21-74 effector
MNMESKHYTLGLDIGIASIGWAVLNNNVDGTPDRIIDLGVRLFESAEVQNTGESLAAPRRNARSARRRLRRHRHRLERIRYLLVQQGVLTQEEMTHLYDKCSMLSPYQLRTEGLDRILNAQEFSRVLIHLGQRRGYLSNSTAEEAKNEKENGVIKSAILENQQRMEHGGYRTIGEMMYRDAAFWETINGIRYHCTRNKAGNYHFTVDRASILSEVHILFEAQRRLGSPWASQETEDTYAAILSSQRSFDEGPGGDSPFRKGISERVGNCTLIPTELRAAKADETFEYFKLLQDLNHMRLVDSNGSHPLTQQQRALLEAAAFRTANLTYGQLRKKLGISDEVRFAGLYYGQDSIEKAEKRKWAQMQSYHKIRTALDKVSKDAISMLTQDQLDAIGEIVTAYKADAARIEHLQAAGIPKEYHNALLSLSFSKYGKLSCCAMRKLIPFLQQGMRYDEACKAAGMNFHGANGNVEKLSDFLDEITNPVVRRAVSQTIKVVNAVVRTYGNPDAVRIELAREMSHSFDERNKIKKRQEDGRRKNEQIKAQILETKAGHRVTGLDIVKFKLFQEQDGVCPYSGKALDVQRLYEPGYADVDHIIPYSRCFDDSYSNKVLVLASENRQKGNCTPYEYFGADERRWHEFSVRVGASVRDFKKRQKLLNTSFGEEQGKEFIQRNLNDTQHITRVVYNYLRNNLSFADSTYANAPVQAVSGTVTATLRGRWGIEKMREDGDLHHCKDAVVIAATSPSMIQRLSNYYKEEERLFMGKTHFVDPETGEVLTRKAFQQRFAPKFPQPWDRFREELEARLDPVNPMDAVMALHLSTYEPDEDITPVFVSHMPKHTVTGAAHEETIRGKTETGTVAKTALTALKLDKHGEIEGYYNPQTDPRLYQALVERLKQFGGDGAKAFVEPFYKPKKDGTPGPRVDKVKIAKKASLSVSTGRGVADNGNMVRIDVFHVPDDGYYFVPIYVADTKKAALPSKAVVAHKLPEAWKQMKPEHFLFSLFKGDLIQLENRKGISLLLTKEAIGEKTIQVKSGLFYFCGADISNGSIEIETHDRRYGKKSLGLKTLTAIEKYQVDVLGNVNKVKLPEKRLEFRGRK

SEQ ID NO: 1585 - protein, 1127 aa, Unknown
  Description of Unknown: uncultivated organism with predicted taxonomy: Clostridiales
  MG21-75 effector
MNYRIGLDLGIASVGWAVLEDDYTGKPKRIVKLGARIFDSAENPKDGSSLALNRRETRETRRRLRRRNHRIKRTKNLLEKYNIMTTKEIENMYATYKFQFNPYELRVKGLDEKLTNSELSRILISFVKRRGYKSNSKSEETNDKEMGKLLTATKENELLMKEKGYRTVGEMYLKDEKFKMQMPDGRVLLKVRNTTDDYKNTPLRKLLLDETKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKAKVTLTYASLRTALNLEGNERFNMIHYKATNVFSDEINKKAEKERKFKEFESYHKMRVAMDKAEKNYILKLSTDELDVIGTVLTLYKNDNKRIEKLAQLNLPENIINEILKLSFSKVGNLSIKAMKKIIPYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGICVYSGKRISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNICDTQYISRLMYNLIKNHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKTYAEWKEMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 1586 - protein, 1100 aa, Unknown
  Description of Unknown: uncultivated organism with predicted taxonomy: Clostridiales bacterium 42_27
  MG21-76 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEEYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1587 - protein, 1098 aa, Unknown
  Description of Unknown: uncultivated organism with predicted taxonomy: Clostridiales
  MG21-77 effector
LSLRYTLGLDIGIASVGWAVLEDNIDGEPIKIERLGVRIFDKAEQPKTGASLAEPRREARGQRRTIRRRRHRKDRIKQLIQQNGIMTRVEMAEMFEHSQFETSVYELRVQALERALTKQEFVRVLIHLAQRRGYKSNSKSEEAKDKENGKVKIAISENKQCMEENGYRTIGEMLLKDDRFWECNPDGTKIFVPHNHPDDYRTTVERSMVEDEIRLIFSRQHALGVSYATSEFEEAYLEIWGSQRNFDEGPGAKSPYGGNMIEKMLGHCTFEKDEPRAAKGSYSAEYFRLLQDVNHLRLVKNNGESNALTAEQKQIYIDLVMKSATASYAQLRKKLELSNDVSFNMLRYGSDEIGKVERKKLGHMKFYHEMRKALNTVQKDAISTVSWEQRDEIARILLCYKSDDKRKAQLEKLDIPHEFIPALLTLSTSKTAHLSAKALRKLIPYLEKDMTYAEACKEVYGEHKSSITKKNKLSLFDIEPINNPVVRRAVSQTIRVINAVVREYGAPEVVRVELAREMGKPYDVRTQITKKQEANAKKNEEVKQKIREIKGLEPTGQDIVKFKLFQDQNGVCLYSGQSLDITRLFEAGYVDVDHIIPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKQVFVSRKQTHKISGAAHEATIRSAKKPGGSISKKPLTSLSLNKKTGEIEKYYAPESDRLLYEALKKRLKEFDGNAEKAFAEPFYKPKRDGTRGPLVKKVKIYEKKTITVPVGGGNADNGSMIRVDVFYIEGDGYYYVPIYITDVVKDELPNRAVVTQKSHGEWKVMDDKDFLFSMYPHDLIYVERKEAFTLDAPKNSSLDPTISKTKGFFYYRSFDSGTGSFKIYTHDRSYSKKSLGGKTLSCLKKYTVDVLGNYSEVSLPEKRKPLRG

SEQ ID NO: 1588 - protein, 1100 aa, Unknown
  Description of Unknown: uncultivated organism with predicted taxonomy: Clostridiales bacterium 42_27
  MG21-78 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEEYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1589 - protein, 1100 aa, Unknown
  Description of Unknown: uncultivated organism with predicted taxonomy: Clostridiales
  MG21-79 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMFRDERFWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNNLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDEACTRVYGDHRGLRSGQRTNRLSLKDMEEITNPVVRRAVSQTIKVINAVVRTYGPPDVVRIELAREMSRTFDERRKMEKRQDDNRAANERAKDQISEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRTVYNLIRNHLAFAESAYRKKPVQAVNGAVTAMLRGRWGVQKIREDSDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKIREKATVGLPVRDGIAANGSMVRIDVFYVEDDGYYFVPIYVADTKKESLPNKAVVAYKAYSEWKEMKDENFIFSLYPRDLVCIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1590 - protein, 1100 aa, Unknown
  Description of Unknown: uncultivated organism with predicted taxonomy: Clostridiales
  MG21-80 effector
MTLQSIRYTLGLDIGIASVGWAVLRNGLDGEPYKIENLGVRIFDKAEVPKTGASLAAPRREARSSRRVVRRRRHRKERIKYLIEQEGIMTQTEMMQLFQNSSFEKSVYEIRVEALDRLLTREEAVRLLIHFAQRRGYKSNSKAEEAKDNENGVIKQAISQNQQSMKEHGYRTFGEMLLMDDRFYYTQPDGARIFIPHNKASDYKVTAERGMLADELHMIFAAQRSLGSLWFSDPFEIAYMDIWSSQRSFDKGPGGDSPYSGNQVEKNWGKCTFEKDKLRAPKASYSAEYFRLLQDVNHLRIVSLDGASFPLNQEQRDTVVVAARKSSSLTYAQLRKKLKLSDDQYFNALYYGDKTTAEVEKKKFGHLQFYRQLRTALDKVEKGAADTLTWEQRDEIARILTVYKADDRRTDELQKAGIPEKYIDALLPLSPTKAMHLSVTAIKKIIPYLEAGMPYSDALSKAYGNQTNASTSSKKHKLSLNDIEEITNPVVRRAVSQSIKVINAIVRQYGAPERVRIELAREMGKNFKDRRMIETRQTDNAAKNERIKAQISEYKSDHITGQDIVKFKLFKEQDGICLYSGKSLDIARLFEPGYVDIDHIIPYSISFDDSYNNKVLVQSSENRQKGNRIPYAYFGQNSDRWEKYETLVNNTVRSYRKRKNLLLKSLSEAQIDGFKQRNLQDTQYLSKVVFRLIEDHLQFAKTAPGKKHTQPVNGAITAQVRKRLGIEKIREDGDLHHAMDAAVIACITPGMIQRITKYAQNHERFYATAKGYVDIKTGEVLTRAQYEAMDDIRFPEPWAGFRLELEARVSDHPQEAIAQLKLPHYENSEEIRPIFVSRMPNHKVTGAAHLETIRSKKGGAGSTVTKTALTELKLGKDGEIAGYCRKEDDPLLYEALKARLKAFGGDGKKAFAEPFHKPKHNGEPGPIVNKVKIQESATLTVPVNHGVAANGSMVRLDVFYVDGDGYYFVPIYTADIVKPKLPNRAVVAGKKASEWKMIDDNHFVFSLYPKDLLRIRSNKGIKLKAVNKNADLQEYSANDCLCYYVGFDIATGAFTVESHDRRLNRRGLGGKTLLSIEKYQVDVLGNYFPVALPEKRMKFR

SEQ ID NO: 1591 - protein, 1100 aa, Unknown
  Description of Unknown: uncultivated organism with predicted taxonomy: Clostridiales
  MG21-81 effector
MSDFHYALGLDIGIGSVGWAVLRNQPNGEPDRIQDLGVRIFDKAEQPKTGASLAAPRRDARSARRRLRRHRHRLERIRYLMEQHDIMPVSDIQAMYAAGGFEKSPYQLRAEALDRPLSKEELVRVLIHLAQRRGYRSNSTAEAAKNEKETGKVKSAIEENRACMEQHGYRTVGEMMFRDERFWQKHPDGTRCHQTRNKAEDYRFTVERTAIVDEAKQIFTAQRRFGAGWMDDGLEAAYLAVLESQRSFDEGPGGDSPFHGGIGERVGFCTFEPDEQRAAKATYTFEYFKLLQDLNHMRLAGNGTAPQPLNAQQREILKAAALQSASLSYGQIRKKLALDENVFFHHLYYGDKPKEEAEKRKWPQMQSYHKMRTALDKVGKGTINTLTETQLNAIATILTQYKSDARRIEALREAGIPAQFDDALLPLSFSKYGNLSVTAMQKLIPLLEQGMRYDEACTQIYGDHRGLHPEQRKNRLSLRDMREITNPVVRRAVSQTIKVVNAVVRTYGPPDVVRIELAREMSQNFEERRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDETRWHEYEVRVENLIRNYRKRQKLLKKRLTEEESAGFIDRNLKDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPRHQIDLLKLATYESDEKIRPVFVSRMPNHKVTGAAHAETIRSSKMGDGYTVTKTPLANLKLNKFGEIEGYYNPASDTLLYDALLARLKDFGGDGAKAFAEPFYKPKKDGTPGPRVDKVKICEKATTGLPVRDGIAANGSMVRIDVFYVEDDGYYFVPIYVADTKKAELPNKAVVAYKAYSDWKEMIDENFLFSLYPGDLVRIQSRKGIKLNIAKGGTGEKEIVRQDGMYYYQGANIATGAIALATHDRRYLQSGLGLKTLQSIEKYQVDVLGNYYKVDLPEKRMKFSEEG

SEQ ID NO: 1592 - protein, 1100 aa, Unknown
  Description of Unknown: uncultivated organism with predicted taxonomy: Clostridiales bacterium 42_27
  MG21-82 effector
MSEFHYALGLDIGIGSVGWAVLRNQPNGEPDRIQDLGVRIFDKAEQPKTGASLAAPRRDARSARRRLRRHRHRLERIRYLMEQHGIMPVADIQAMYAASGFQKSPYQLRAEALDRPLTKEEAVRVLIHLAQRRGYKSNSTAEAAKDEKETGKVKTAIEENRRCMAEHSYRTVGEMMYRDERFWQKHPDGTRYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1593 - protein, 878 aa, Unknown
  Description of Unknown: uncultivated organism with predicted taxonomy: Clostridiales bacterium 42_27
  MG21-83 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYQFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIE

SEQ ID NO: 1594 - protein, 1100 aa, Unknown
  Description of Unknown: uncultivated organism with predicted taxonomy: Clostridiales
  MG21-84 effector
MSEFHYALGLDIGIGSVGWAVLRNQPNGEPDRIQDLGVRIFDKAEQPKTGASLAAPRRDARSARRRLRRHRHRLERIRYMMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLSEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1595 - protein, 1138 aa, Unknown
  Description of Unknown: uncultivated organism with predicted taxonomy: Clostridiales
  MG21-85 effector
LSLRYTLGLDIGIASVGWAVLKNDINGVPIKIEDLGAVAFSAAEPTGKVQKKKSGSKTPAPTLASNLRKIRCPRRTIRRKRHRKDRIKQLIQQNGIMTRVEMAEMFEHSQFETSVYELRVQALERALTKQEFVRVLIHLAQRRGYKSNSESEEAKDKENGKVKIAISENKQCMEKNGYRTIGEMLLNDDRFWEDNHDGTKIFVPHNHPDDYRTTVERSMVEDEIRLIFSRQRALGVPYATSEFEEAYLKIWGGQRNFDDGPGYEIPPKDDGTGGKYSRYGGNMIEKMLGHCTFEKDEPRAAKGSYSAEYFRLLQDVNHLRLVKNNGESSALTAEQKQIYIDLVMESEAASYEEAASYEELREKLGLSNDILFNMLRYGSDEIGKVERKKLGHMKFYHEMRKALNMVQKDAISTVSWEQRDEIARILLCYKSDDKRKAQLEKLDIPQEFILKLLTLSTSKTAHLSVKALRKLIPYLEEGMTYAEACKEVYGEQKISVTKKNKLSLFDIEPINNPVVRRAVAKTIRVINAVVRKYGPPEVVRVELAREMGKSKADRDKIDAEQKANAKRNEELRQQIKKIKGAEPTGQDIVKFKLFQDQNGVCLYSGQNLDITRLFEAGYVEIDHIIPYSISLDNSYANKVLVLKEENQNKGRRTPYEYFGADSKRWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAADAAVVACVSPSMIQKITQYTKHRECIRETPKGYLDTETGELMTREAYDAKYPPRFPAPWERFRQELEARLSDNPAEEIARLHLATYDSEEEIKPVFVSRKPERKTTGAAHKDTIYRKADGGYIDKVPLTKLTLDKKTGEIEKYYAPESDRLLYEALKKRLKEFDGNAKEAFAEPFYKPKRDGTSGPLVKKVKLYEKYNNTVEVKRGDARASNKHIGCARNDSNSMIRVDVFYIEGDGYYYVPIYITDVVKDELPNRAVVTQKSHGEWKVMDDKDFLFSMYPHDLIYVERKEAFTLDALKNSSLDPTISKTKGFFYYRSFDSGTGSFKIYTHDSSYSKKSLGGKTLSCLKKYTVDILGNYSEVSLPEKRKPLRG

SEQ ID NO: 1596 - protein, 1100 aa, Unknown
  Description of Unknown: uncultivated organism with predicted taxonomy: Firmicutes
  MG21-86 effector
MSDFHYALGLDIGIGSVGWAVLRNRPDGEPDRIQDLGVRIFDKAEQPKTGASLAAPRRDARSARRRLRRHRHRLERIRYLMEQHGIMPVSDIQAMYAAGGFEKSPYQLRAEALDRPLSREELVRVLIHLAQRRGYRSNSTAEAAKNEKETGKVKSAIEENRACMEQHGYRTVGEMMLRDERFWQKHPDGTRCHQTRNKAEDYRFTVERTAIVDEAKQIFTAQRRFGADWMDDGLEAAYLAVLESQRSFDEGPGGDSPFHGGIGERVGFCTFEPDEQRAAKATYTFEYFKLLQDLNHMRLAGNGTAPQPLNAQQREILKAAALQSASLSYGQIRKKLALDENVFFNHLYYGDKPKEEAEKRKWPQMQSYHKMRTALDKVGKGTINTLTETQLNAIATILTQYKSDARRIEALREAGIPAQFDDALLPLSFSKYGNLSVTAMQKLIPLLEQGMRYDEACTQIYGDHRGLHPEQRKNRLSLRDMREITNPVVRRAVSQTIKVVNAVVRTYGPPDVVRIELAREMSQNFEERRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDETRWHEYEVRVENLIRNYRKRQKLLKKRLTEEESAGFIDRNLKDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPRHQIDLLKLATYESDEKIRPVFVSRMPNHKVTGAAHAETIRSSKMGDGYTVTKTPLANLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKAELPNKAVVAYKAYSDWKEMIDENFLFSLYPGDLVRIQSRKGIKLNIAKGGTGEKEIVRQDGMYYYQGANIATGAIALATHDRRYLQSGLGLKTLQSIEKYQVDVLGNYYKVDLPEKRMKFSEEG

SEQ ID NO: 1597 - protein, 980 aa, Unknown
  Description of Unknown: uncultivated organism with predicted taxonomy: Clostridiales
  MG21-87 effector
EAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFVQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRASGITVGAIQIETHDRRYLQPSLGIKTLQSIEKYQVDVLGNYYKVDLPEKRMTFSKEG

SEQ ID NO: 1598 - protein, 1098 aa, Unknown
  Description of Unknown: uncultivated organism with predicted taxonomy: Clostridiales
  MG21-88 effector
LSLRYTLGLDIGIASVGWAVLENNIDGEPIKIERLGVRIFDKAEQPKTGASLAEPRREARGQRRTIRRRRHRKDRIKQLIQQNGIMTRVEMAEMFEHSQFETSVYELRVQALERALTKQEFVRVLIHLAQRRGYKSNSKSEEAKDKENGKVKIAISENKQCMEENGYRTIGEMLLKDDRFWECNPDGTKIFVPHNHPDDYRTTVERSMVEDEIRLIFSRQHALGVSYATSEFEEAYLEIWGSQRNFDEGPGGKSPYGGNMIEKMLGHCTFEKDEPRAAKGSYSAEYFRLLQDVNHLRLVKNNGESCALTREQKQIYIDLVMKSAAASYAQLRKKLELSNDISFNMLRYGSDEIGKVERKKLGHMKFYHEMRKALNTVQKDAISTVSWEQRDEIARILLCYKSDDKRKAQLEKLDIPHEFIPALLTLSTSKTAHLSAKALRKLIPHLEKGMTYAEACKEVYGEQKSSITKKNKLSLFDIEPINNPVVRRAVSQTIRVINAVVREYGAPEVVRVELAREMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKPVFVSRKQTHKISGAAHEATIRSAKKPGGSISKKPLTSLSLNKKTGEIEGYYAPESDRLLYEALKKRLEEFDGNAEKAFAEPFYKPKRDGTRGPLVKKVKIYEKKTITVPVGGGNADNGSMIRVDVFYVEDDGYYYVPIYTADVIKGALPNRAVVAHKSHGEWKVMDDKDFLFSMYPNELLYIESRKGIKLKTKKGSSRQEEIIRKAGLYYFKWLNIAANALFIITHDNGYEQPSLGGKTLSCLKKYTVDALGNYSEVSLPEKRKPLRG

SEQ ID NO: 1599 - protein, 1100 aa, Unknown; identical to SEQ ID NO: 1544
  Description of Unknown: uncultivated organism with predicted taxonomy: Clostridiales
  MG21-89 effector

SEQ ID NO: 1600 - protein, 1100 aa, Unknown; identical to SEQ ID NO: 1578
  Description of Unknown: uncultivated organism with predicted taxonomy: Clostridiales bacterium 42_27
  MG21-90 effector

SEQ ID NO: 1601 - protein, 1100 aa, Unknown; identical to SEQ ID NO: 1578
  Description of Unknown: uncultivated organism with predicted taxonomy: Clostridiales bacterium 42_27
  MG21-91 effector

SEQ ID NO: 1602 - protein, 919 aa, Unknown
  Description of Unknown: uncultivated organism with predicted taxonomy: Ruminococcaceae bacterium TF06-43
  MG21-92 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLNPIDPRHQIDLLKLETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDG

SEQ ID NO: 1603 - protein, 1100 aa, Unknown; identical to SEQ ID NO: 1544
  Description of Unknown: uncultivated organism with predicted taxonomy: Ruminococcaceae bacterium TF06-43
  MG21-93 effector

SEQ ID NO: 1604 - protein, 1100 aa, Unknown
  Description of Unknown: uncultivated organism with predicted taxonomy: Clostridiales
  MG21-94 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1605 - protein, 1036 aa, Unknown
  Description of Unknown: uncultivated organism with predicted taxonomy: Clostridiales bacterium 42_27
  MG21-95 effector
RRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTHYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1606 - protein, 1100 aa, Unknown; identical to SEQ ID NO: 1578
  Description of Unknown: uncultivated organism with predicted taxonomy: Clostridiales bacterium 42_27
  MG21-96 effector

SEQ ID NO: 1607 - protein, 1128 aa, Unknown
  Description of Unknown: uncultivated organism with predicted taxonomy: Clostridium
  MG21-97 effector
MNYRIGLDLGIASVGWAILEDDNKGNPKRIVKLGSRIFDAAENPKDGSSLALNRREARNTRRRLRRRNHRIKRTKNLLEKYNIITIKEIENMYATYKFQFNPYELRVKGLDEKLTNSELARVLISFVKRRGYKSNSKAEETSNKEMGKLLVATKENEILMKEKNYRTIGEMYLKDEKFKIQMPDGRVLFKVRNTTDEYKNTPLRKLLLDEIKQILEKQKELNSNITDSFIDEYINIFTSQRNFDDGPSQPSIYAGNQIEKMLGKCTFEKEENRSAKATYTFEYFKLLQDINHIKIEEYHLKENGTREVIKRTLTEEERNIIINLAKTKVTLTYDSLRTALKLTTNERFNMINYKRTDIFNDEENKKVEKDRRIKEFESYHKIRVAMDRIEKNYINKLNSDDLDTIGTVLTLYKNDNKRIEKLKEINLPEDIVNELLKLSFSKVGNLSIKAMKKIIPYLEQGYTYDKAVNEVYEDFRGIINTKKKKKIALRDLEQELSNPVVKRAVSQAIKVLNAITTTYGKPDIINIELARQLSKKFADRQNIKKKQEQNMQNNDKAREEILKLGKNNPTGQDIVKYKLWQEQDGICVYSGKHISIEDLFTEAVDVDHIIPYSMCFDDTYKNKVLVLASENRQKGNRIPYQYLKEKGRNLEEYEVRVNNIIKNYYKKKRLLRQNFTREDATEWKDRNIQDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAVKIYYENYDDVKPVFISRMPRRKVTGQAHLDTIRGIRKNEEGIKTLTKTELTKLKLDKNGEIEKYPDSQKQDDKLLYKALVDQLRKFGGNGEEAFKRPFYKPKSDGTPGPLVKKVKLEDKTTLAVELNNGKAIAANGDMIRIDVFKVDGEGYYFVPIYVSDTIKSKLPNKACVAAKQYSEWKDMKDENFIFSLYPRDLIYIKSKNKIKLTSINKENKETKEISEMFAYYIKSGISTAAISIINHNGEYEQNSLGIKTLKEFKKFEVDVLGNYHEVKLPEKRQSFKNLKKKGGSLK

SEQ ID NO: 1608 - protein, 1134 aa, Unknown
  Description of Unknown: uncultivated organism with predicted taxonomy: Clostridiales
  MG21-98 effector
LSLRYTLGLDIGIASVGWAVLKNDINGVPIKIEDLGAVAFSAAEPTGKVQKKKSNSKTPAPTLASNLRKIRCPRRTIRRKRHRKDRIKQLIQQNGIMTRVEMAEMFEHSQFETSVYELRVQALERALTKQELVRVLIHLAQRRGYKSNSKSEEAKDKENGKVKIAISENKQCMEENGYRTIGEMLLNDDRFWEDNHDGTKNFVPHNHPDDYRTTVERSMVEDEIRLIFSRQRALGVPYATSEFEEAYLKIWGGQRNFDDGPGYEIPPKDDGTEGKYSRYGGNMIEKMLGHCTFEKDEPRAAKGSYSAEYFRLLQDVNHLRLVKNNGESSALTAEQKQIYIDLVMKSATASYAKLRKKLDLSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSVKALRKLIPHLEKGMTYAEACKEVYGEQKISVTKKNKLSLFDIEPINNPVVRRAVAKTIRVINAVVRKYGPPEVVRVELAREMGKSKADRDKIDAEQKANAKRNEELRQQIKKIKGAEPTGQDIVKFKLFQEQKGVCLYSGKNIEIDRLFKPEAGYVEIDHIIPYSISLDNSYANKVLVLKEENQNKGRRTPYEYFGADSKRWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAADAAVVACVSPSMIQKITQYTKHRECIRETPKGYLDTETGELMTREAYDAKYSPRFPAPWERFRQELEARLSDNPAEEIARLHLATYDSEEEIKPVFVSRKPKRKTTGAAHKDTIYRKTDGGYIDKVPLTKLTLDKKTGEIEKYYAPESDRLLYEALKKRLEEFDGNAKEAFAEPFYKPKRDGTRGPLVKKVKLYETYNNTVEVKRGDARASNKHIGCARNDSNSMIRVDVFYIEDDGYYYVPIYITDVVKDELPNKAVVQKKLPKDWKEMDDRDFLFSMYPNELLYIESRKGIKLKTKKGSSRQEEIIRKAGLYYFKRLDIASGNLFIITHDHSYEQPSLGGKTLSCLKKYTIDVLGNYSEVSLPEKRKPLRG

SEQ ID NO: 1609 - protein, 1100 aa, Unknown; identical to SEQ ID NO: 1538
  Description of Unknown: uncultivated organism with predicted taxonomy: Clostridiales bacterium 42_27
  MG21-99 effector

SEQ ID NO: 1610 - protein, 1100 aa, Unknown
  Description of Unknown: uncultivated organism with predicted taxonomy: Clostridiales
  MG21-100 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVYLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVCIQSRKGIKLNLAKGGTGEKEIVRQEGMYYYRAAGITVGAIQIETHDRRYLQPSLGIKTLQSIEKYQVDVLGNYQKVDLPEKRMTFSKEG

SEQ ID NO: 1611 - protein, 1127 aa, Unknown
  Description of Unknown: uncultivated organism with predicted taxonomy: Clostridiales
  MG21-101 effector
MNYRIGLDLGIASVGWAVLEDDYMGKPKRIVKLGARIFDSAENPKDGSSLALNRREARETRRRLRRRNHRIKRTKNLLEKYNIMTTKEIEDMYATYKFQFNPYELRVKGLDEKLTNSELSRILISFVKRRGYKSNSKSEETNDKEMGKLLTATKENELLMKEKGYRTVGEMYLKDEKFKMQMPDGRILLKVRNTTDDYKNTPLRKLLLDEIKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKTKVTLTYASLRIALNLAGNERFNMIHYKATNVFSDEINKEAEKERKFKEFESYHKMRVSMDKAEKNYILKLSTDELDVIGTVLTLYKNDNKRIEKLAQLNLPENIINEMLKLSFSKVGNLSIKAMKKIIPYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNIQDTQYISRLMYNLIKNHVQFSNNENFERKVFTVNGQITSHIGKRLGINKIRENGDEHHATDAVIIATVSQGMIQRITKYYQYIDGRYEKNSGEYIDMETGEIITKEQYEAKNGSNFPEPWPKFRKELDIRTTCKTKARMEECLLTEKIFYDDYDDVKPIFISRMPKRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKLYAEWKEMQDKDFIFSLYPRDLFYVKSKNKIKLTSINKQDKESLETNELFAYYVKAGISTAAIACINHNGEYEQNSLGIKRLQEFKKYEVDVLGNYHEVKLPEKRQDFSNLKKGGSLK

SEQ ID NO: 1612 - protein, 1128 aa, Unknown; identical to SEQ ID NO: 1554
  Description of Unknown: uncultivated organism with predicted taxonomy: Clostridium
  MG21-102 effector

SEQ ID NO: 1613 - protein, 1100 aa, Unknown
  Description of Unknown: uncultivated organism with predicted taxonomy: Clostridiales
  MG21-103 effector
MSEFHYALGLDIGIGSVGWAVLRNQPNGEPDRIQDLGVRIFDKAEQPKTGASLAAPRRDARSARRRLRRHRHRLERIRYLVEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVSFCTFEPDQQRAAKATYTFEYFKLLQDLNHMRLAGRGMSPQPLNAQQREILKETALRSASLSYGQLRKKLALADDTFFSGLYYGDKSREEAEKRKCPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGQDEARWHGYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFVSRMPNHKVTGAAHAETIRSSKGGDGFTVTKTPLTNLKLNKFGEIEGYYNPASDTLLYDSLLARLKDFGGDGAKAFAQPFYKPKKDGTPGPRVDKVKICEKATIGLPVRNGIAANGSMIRIDVFYVEDDGYYFVPIYVADTKKERLPNKAVVAYKAYSEWKEMKDENFVFSLYPGDLVCIQSRKGIKLNLAKGGTGEKEIVRQKGMYYYRAAGITVGAIQIETHDRRYLQPSLGIKTLQSIEKYQVDVLGNYHKVDLPEKRMTFSKEG

SEQ ID NO: 1614 - protein, 1100 aa, Unknown
  Description of Unknown: uncultivated organism with predicted taxonomy: Clostridiales bacterium 42_27
  MG21-104 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1615 - protein, 1100 aa, Unknown
  Description of Unknown: uncultivated organism with predicted taxonomy: Clostridiales bacterium 42_27
  MG21-105 effector
MSEFHYALGLDIGIGSVGWAVLRNQPTGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLANLKLNKFGEIEGYYNPASDTLLYDALLARLKAFGGDGAKAFAQPFYKPKKDGTPGPRVDKVKICEKATVGLPVRDGIAANGSMVRIDVFYVEDDGYYFVPIYVADTKKESLPNKAAVAMKPYNLWKEMNDENFAFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1616 - protein, 786 aa, Unknown
  Description of Unknown: uncultivated organism with predicted taxonomy: Oscillibacter sp. CAG:241_62_21
  MG21-106 effector
MLEFHYALGLDIGIGSVGWAVLRNQENGEPDRIQDLGVRIFDKAEQPKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADNYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQ

SEQ ID NO: 1617 - protein, 1128 aa, Unknown
  Description of Unknown: uncultivated organism with predicted taxonomy: Clostridium
  MG21-107 effector
MNYRIGLDLGIASVGWAILEDDNKGNPKRIVKLGSRIFDAAENPKDGSSLALNRREARNTRRRLRRRNHRIKRTKNLLEKYNIITIKEIENMYATYKFQFNPYELRVKGLDEKLTNSELARVLISFVKRRGYKSNSKAEETSNKEMGKLLVATKENEILMKEKNYRTIGEMYLKDEKFKIQMPDGRVLFKVRNTTDEYKNTPLRKLLLDEIKQILEKQKELNSNITDSFIDEYINIFTSQRNFDDGPSQPSIYAGNQIEKMLGKCTFEKEENRSAKATYTFEYFKLLQDINHIKIEEYHLKENGTREVIKRTLTEEERNIIINLAKTKVTLTYDSLRTALKLTTNERFNMINYKRTDIFNDEENKKVEKDRRIKEFESYHKIRVAMDRIEKNYINKLNSDDLDTIGTVLTLYKNDNKRIEKLKEINLPEDIVNELLKLSFSKVGNLSIKAMKKIIPYLEQGYTYDKAVNEVYEDFRGIINTKKKKKIALRDLEQELSNPVVKRAVSQAIKVLNAITTTYGKPDIINIELARQLSKKFADRQNIKKKQEQNMQNNDKAREEILKLGKNNPTGQDIVKYKLWQEQDGICVYSGKHISIEDLFTEAVDVDHIIPYSMCFDDTYKNKVLVLASENRQKGNRIPYQYLKEKGRNLEEYEVRVNNIIKNYYKKKRLLRQNFTREDATEWKDRNIQDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAEKIYYENYDDVKPVFISRMPRRKVTGQAHLDTIRGIRKNEEGIKTLTKTELTKLKLDKNGEIEKYPDSQKQDDKLLYKALVDQLRKFGGNGEEAFKRPFYKPKSDGTPGPLVKKVKLEDKTTLAVELNNGKAIVANGDMIRIDVFKVDGEGYYFVPIYVSDTIKSKLPNKACVAAKQYSEWKDMKDENFIFSLYPRDLIYIKSKNKIKLTSINKENKENKEISEMFAYYIKSGISTATISIINHNGEYEQNSLGIKTLKEFKKFEVDVLGNYHEVKLPEKRQSFKNLKKKGGSLK

SEQ ID NO: 1618 - protein, 1100 aa, Unknown; identical to SEQ ID NO: 1544
  Description of Unknown: uncultivated organism with predicted taxonomy: Clostridiales
  MG21-108 effector

SEQ ID NO: 1619 - protein, 1045 aa, Unknown
  Description of Unknown: uncultivated organism with predicted taxonomy: Clostridiales bacterium 42_27
  MG21-109 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAG

SEQ ID NO: 1620 - protein, 1100 aa, Unknown
  Description of Unknown: uncultivated organism with predicted taxonomy: Oscillibacter sp. CAG:241_62_21
  MG21-110 effector
MLEFHYALGLDIGIGSVGWAVLRNQENGEPDRIQDLGVRIFDKAEQSKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADNYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELCYGDHSREDAEKRKWPQMQSYHKIRTALDKVGKGTISTLTEEQLNAIAEILTRYKSDAKRIAALREAGIPPQLDGALLPLSFSKYGSLSVKAMQKLIPLLEKGQRYDQACTQIYGDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPENRMTFSKEG

SEQ ID NO: 1621 - protein, 1100 aa, Unknown
  Description of Unknown: uncultivated organism with predicted taxonomy: Clostridiales
  MG21-111 effector
MSEFHYALGLDIGIGSVGWAVLRNQPNGEPDRIQDLGVRIFDKAEQPKTGASLAAPRRDARSARRRLRRHRHRLERIRYLVEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVSFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGQDEARWHGYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFVSRMPNHKVTGAAHAETIRRSKGGDGFTVTKTPLTNLKLNKFGEIEGYYNPASDTLLYDSLLARLKDFGGDGAKAFAQPFYKPKKDGTPGPRVDKVKICEKATIGLPVRNGIAANGSMIRIDVFYVEDDGYYFVPIYVADTKKERLPNKAVVAYKAYSEWKEMKDENFVFSLYPGDLVCIQSRKGIKLNLAKGGTGEKEIVRQKGMYYYRAAGITVGAIQIETHDRRYLQPSLGIKTLQSIEKYQVDVLGNYHKVDLPEKRMTFSKEG

SEQ ID NO: 1622 - protein, 1100 aa, Unknown; identical to SEQ ID NO: 1538
  Description of Unknown: uncultivated organism with predicted taxonomy: Clostridiales bacterium 42_27
  MG21-112 effector

SEQ ID NO: 1623 - protein, 1100 aa, Unknown; identical to SEQ ID NO: 1614
  Description of Unknown: uncultivated organism with predicted taxonomy: Clostridiales bacterium 42_27
  MG21-113 effector

SEQ ID NO: 1624 - protein, 1028 aa, Unknown
  Description of Unknown: uncultivated organism with predicted taxonomy: Clostridiales bacterium 42_27
  MG21-114 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKIAIEENRRCMAEHGYRTVGEMMYRDERFWQKHPDGTRYHQTRNKAEDYRFTVERAAIVDEVRQIFAAQRRLGTAWMDEDMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVSKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLTFAESNYRKKPVQAVNGAVTAMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTG

SEQ ID NO: 1625 - protein, 1107 aa, Unknown
  Description of Unknown: uncultivated organism with predicted taxonomy: Clostridiales
  MG21-115 effector
LSLRYTLGLDIGIASVGWAVLENNIDGEPIKIERLGVRIFDKAEQPKTGASLAEPRREARGQRRTIRRRRHRKDRIKQLIQQNGIMTRVEMTEMFEHSQFETSVYELRVQALERALTKQEFVRVLIHLAQRRGYKSNSKSEEAKDKENGKVKSAISENKKCMEENGYRTIGEMLLNDDRFWEYNPDGTKIFVPHNHPDDYRTTVERSMVEDEIRLIFSRQHALGVPYATSEFEEAYLEIWGRQRNFDEGPGGKSPYGGNMIEKMLGHCTFEKDEPRAAKGSYSAEYFRLLQDVNHLRLVKNNGESCALTREQKQIYIDLVMKSAAASYAQLRKKLELSNDISFNMLRYGSDEIGKVERKKLGHMKFYHEMRKALNTVQKDAIATVSWEQRDEIARILLCYKSDDKRKAQLEKLDIPREFIPALLTLSTSKTAHLSAKALRKLIPHLEKGMTYAEACKEVYGEQKSSITKKNKLSLFDIEPINNPVVRRAVSQTIRVINAVVREYGAPEVVRVELAREMGKPYDVRTQMTKKQETNAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQVLSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKQVFVSRKQTHKISGAAHKDTIYRKADGGYIDKVPLTRLTLDKQTGEIKNYYAPESDRLLYEALKKRLEEFDGNAEKAFAEPFYKPRRDGTRGPLVKKVKLYETYNNTVEVKRGDARASNKHIGCAKNDSMIRVDVFYMEDDGYYYVPIYTADVIKGVLPNKAVVRNKLPEDWKEMDDRDFLFSMYPNDLLYIESRRGIKLKTKKGSSRQEEIVRKTGLYYFKGLNIATNALFIITHDNGYEQPSLGGKTLSCLKKYTVDALGNYSEVSLPEKRKPLRG

SEQ ID NO: 1626 - protein, 1100 aa, Unknown; identical to SEQ ID NO: 1544
  Description of Unknown: uncultivated organism with predicted taxonomy: Clostridiales
  MG21-116 effector

SEQ ID NO: 1627 - protein, 1100 aa, Unknown; identical to SEQ ID NO: 1548
  Description of Unknown: uncultivated organism with predicted taxonomy: Clostridiales bacterium 42_27
  MG21-117 effector

SEQ ID NO: 1628 - protein, 897 aa, Unknown
  Description of Unknown: uncultivated organism with predicted taxonomy: Clostridiales bacterium 42_27
  MG21-118 effector
FTVERAAIVDEVRQIFAAQRRLGVVWMDEDMETAYLSVLESQRSFDEGPGGDSPFSGGIGKRVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVARTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMIRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1629 - protein, 1100 aa, Unknown; identical to SEQ ID NO: 1578
  Description of Unknown: uncultivated organism with predicted taxonomy: Clostridiales bacterium 42_27
  MG21-119 effector

SEQ ID NO: 1630 - protein, 1100 aa, Unknown
  Description of Unknown: uncultivated organism with predicted taxonomy: Ruminococcaceae bacterium TF06-43
  MG21-120 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLMNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVCIQSRKGIKLNLAKGGTGEKEIVRQEGMYYYRAAGITVGAIQIETHDRRYLQPSLGIKTLQSIEKYQVDVLGNYQKVDLPEKRMTFSKEG

SEQ ID NO: 1631 - protein, 1100 aa, Unknown
  Description of Unknown: uncultivated organism with predicted taxonomy: Clostridiales
  MG21-121 effector
MSEFHYALGLDIGIGSVGWAVLRNQPNGEPDRIQDLGVRIFDKAEQPKTGASLAAPRRDARSARRRLRRHRHRLERIRYLVEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVSFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGQDEARWHGYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATIGLPVRNGIAANGSMIRIDVFYVEDDGYYFVPIYVVDTKKENLPNKAVVAYKAYSDWKEMRDEDFVFSLYPGDLVCIQSRKGIKLNLAKGGTGEKEIVRQKGMYYYRAAGITVGAIQIETHDRRYLQPSLGIKTLQSIEKYQVDVLGNYHKVDLPEKRMTFSKEG

SEQ ID NO: 1632 - protein, 1109 aa, Unknown; identical to SEQ ID NO: 1579
  Description of Unknown: uncultivated organism
  MG21-122 effector

SEQ ID NO: 1633 - protein, 1100 aa, Unknown; identical to SEQ ID NO: 1538
  Description of Unknown: uncultivated organism with predicted taxonomy: Clostridiales
  MG21-123 effector

SEQ ID NO: 1634 - protein, 943 aa, Unknown
  Description of Unknown: uncultivated organism with predicted taxonomy: Clostridiales bacterium 42_27
  MG21-124 effector
EENRRCMAEHGYRTVGEMMYRDERFWQKHPAGPRYRQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1635 - protein, 1100 aa, Unknown; identical to SEQ ID NO: 1538
  Description of Unknown: uncultivated organism with predicted taxonomy: Clostridiales bacterium 42_27
  MG21-125 effector

SEQ ID NO: 1636 - protein, 772 aa, Unknown
  Description of Unknown: uncultivated organism with predicted taxonomy: Clostridiales bacterium 42_27
  MG21-126 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVAAMLRGRWGVQKIREDGDLHHCLDAAVIAATTPGLVQRLTAYNKHRETWERSPAGYVD

SEQ ID NO: 1637 - protein, 970 aa, Unknown
  Description of Unknown: uncultivated organism with predicted taxonomy: Clostridiales bacterium 42_27
  MG21-127 effector
QRRGYKSNSTAEAAKDEKETGKVKTAIEENRRCMAEHGYRTVGEMMYRDERFWQIHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLNEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLNPIDPRHQIDLLKLETYESDEEIKPVFVSRMPNHKVTGAAHAETIRSSKGGDGFTVTKTPLANLKLNKFGEIEGYYNPASDTLLYDALLARLKAFGGDGAKAFAQPFYKPKKDGTPGPRVDKVKICEKATVGLPVRDGIAANGSMVRIDVFYVEDDGYYFVPIYVADTKKESLPNKAAVAMKPYNLWKEMNDENFAFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1638 - protein, 964 aa, Unknown
  Description of Unknown: uncultivated organism with predicted taxonomy: Clostridiales bacterium 42_27
  MG21-128 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYY

SEQ ID NO: 1639 - protein, 820 aa, Unknown
  Description of Unknown: uncultivated organism with predicted taxonomy: Clostridiales bacterium 42_27
  MG21-129 effector
MYRDERFWQKHPDGTRYHQTRNKAEDYRFTVERAAIVDEVRQIFAAQRRLGTVWMDEDMETAYLSILESQRSFDEGPGGDSPFFGGIGERVGACTFEPDEKRAAKATYTFEYFKLLQDLNRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLRPEQRTNRLSLNDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIARNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEGDGYYFVPIYVADTKKESLPNKAVVAYKAYSEWKEM

SEQ ID NO: 1640 - protein, 889 aa, Unknown
  Description of Unknown: uncultivated organism with predicted taxonomy: Clostridiales bacterium 42_27
  MG21-130 effector
VDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGAHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1641 - protein, 1100 aa, Unknown; identical to SEQ ID NO: 1614
  Description of Unknown: uncultivated organism with predicted taxonomy: Clostridiales bacterium 42_27
  MG21-131 effector

SEQ ID NO: 1642 - protein, 1100 aa, Unknown
  Description of Unknown: uncultivated organism with predicted taxonomy: Clostridiales bacterium 42_27
  MG21-132 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1643 - protein, 1100 aa, Unknown
  Description of Unknown: uncultivated organism with predicted taxonomy: Clostridiales
  MG21-133 effector
MLEFHYALGLDIGIGSVVWAVLRNQENGEPDRIQDLGVRIFDKAEQPKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADDYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPENRMTFSKEG

SEQ ID NO: 1644 - protein, 1100 aa, Unknown; identical to SEQ ID NO: 1614
  Description of Unknown: uncultivated organism with predicted taxonomy: Clostridiales bacterium 42_27
  MG21-134 effector

SEQ ID NO: 1645 - protein, 1100 aa, Unknown; identical to SEQ ID NO: 1538
  Description of Unknown: uncultivated organism with predicted taxonomy: Clostridiales
  MG21-135 effector

SEQ ID NO: 1646 - protein, 1018 aa, Unknown
  Description of Unknown: uncultivated organism with predicted taxonomy: Clostridiales
  MG21-136 effector
LYDKSDMVSPYQLRTEGLDRLLNAREFSKVLIHLAQRRGYQSNSTAEEAKNEKENGIIKTAILENQQRMGRGGYRTIGEMMYRDAAFWETINGIRYHCTRNKAGDYRFTVDRASILAEVSILFEAQRRLGAPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGISDEVRFAGLYYGEDTIEKAEKRKWPQMQSYHKIRTALDKVSKDAIQTLTQDQLDAIGEILAGGVSDAKRINSFCLAGIPEEYHKALLPLSISKRAKLSIAAMRKLIPFLQQGMRYDEACKAAGLDFHGADGKVEKLSDFLNEITNPVVRRAVSQTIKVVKAVVDTYSNRKEMKLDAVRIELAREMHHSIKERNRMKKRQEENREKNEQVKAQILETKPGTRVTGLDIVKFKLYQEQDGICPYSGKPLLIERLYEPGYAEVDHIIPYSRCFDDSYSNKVLVLAEENQQKGNRTPYEYFGANEQRWHEFSARVRASVRDFKKRQKLLNTSFGEEQGKDFIQRNLNDTQHITRVVYNYLRNNLKFADSAYAKAPVRAVNGAVTAMLRGRWGIEKMRGNGDLHHCKDAVVIAATSDSMIKDLTKYYQEEEQLFMGKTHFVDPATGEVLTRKEFQQRFAPKFPQPWDRFREELEVRLDPTNPKEALMALNLSTYEFDPEEEIPPVFVSHMPKHTVTGAAHKETIRGKTETGTAVKTALTSLKLDKNGEIDGYYNPQTDPRLYQALVERLKKFGGDGAKAFAEPFYKPKRDGTPGPRVDKVKIAEKASLSVPTGRGEADNGEMIRIDVFRVPNERKPDDNYYFVPIYVADTKKAILPSKAVVGKKPPEAWKQMKPEHFLFSIFKGDLIYVESKKGISLALAKEAVGEKTIQVKSGLFYFCGADISDGSIKIETHDRRYYKKSLGIKELKAFEKRQVEVLGEVRKVKLPEKRLEFRGRK

SEQ ID NO: 1647 - protein, 1127 aa, Unknown
  Description of Unknown: uncultivated organism with predicted taxonomy: Clostridiales
  MG21-137 effector
MNYRIGLDLGIASVGWAVLEDDYTGKPKRIVKLGARIFDSAENPKDGSSLALNRREARETRRRLRRRNHRIKRTKNLLEKYNIMTTKEIENMYATYKFQFNPYELRVKGLDEKLTNSELSRILISFVKRRGYKSNSKSEETNDKEMGKLLTATKENELLMKEKGYRTVGEMYLKDEKFKMQMPDGRILLKVRNTTDDYKNTPLRKLLLDEIKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKAKVTLTYASLRTALNLESNERFNMIHYKATNVFSDDINKEAEKERKFKEFESYHKMRVAMDKTEKNYILKLSTDELDVIGTVLTLYKNDNKRIEKLAQLNLPENIINEMLKLSFSKVGNLSIKAMKKIILYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNIQDTQYISRLMYNLIKDHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKTYAEWKKMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 1648 - protein, 1100 aa, Unknown
  Description of Unknown: uncultivated organism with predicted taxonomy: Clostridiales bacterium 42_27
  MG21-138 effector
MSEFHYALGLDIGIGSVGWAVLRNQPNGEPDRIQDLGVRIFDKAEQPKTGASLAAPRGDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1649 - protein, 934 aa, Unknown
  Description of Unknown: uncultivated organism with predicted taxonomy: Clostridiales
  MG21-139 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKA

SEQ ID NO: 1650 - protein, 1100 aa, Unknown
  Description of Unknown: uncultivated organism with predicted taxonomy: Clostridiales bacterium 42_27
  MG21-140 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKFLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1651 - protein, 1113 aa, Unknown
  Description of Unknown: uncultivated organism with predicted taxonomy: Firmicutes
  MG21-141 effector
MKKRKKKKKDKKDCHYTLGLDIGIASIGWAVLGNDEEGKPNRIIDLGVRIFDKAEVENTGESLAAPRRDARSARRRLRRHRHRLERIRYLLVQQGVLTQEEMTHLYDKSDMVSPYQLRTEGLDRLLNAQEFSKVLIHLAQRRGYQSNSTAEEAKNEKENGVIKSAILENQQRMERGGYRTIGEMMYRDAAFWETINGIRYHCTRNKAGDYRFTVDRASILLEVSLLFEAQRRLGSPWASQEMEDAYTAILSSQRSFDEGPGGDSPFRKGIADRVGNCTLEPTEQRAAKADVTFERFKLLQDLNHMRLVDNNGSHPLTQQQRDDLEAAAFHTANLTYGQLRKKLGLSEEVRFAGLYYGTDPIEKAEKRKWAQMQSYHKIRMALDKVSKDAILTLTQDQRDAIGEILTAYKADAARIEHLQSAGIPKEYHNALLSLSFSKYGKLSCCAMRKLIPLLQQGMRYDEACREVYQDHRTKEASEKKQRLSLNDIDEITNPVVRRAVSQTIKVVNAVVRIYGNPDAVRIELAREMSHSFDERNKMKKRQEDGRQENEQVKAQILETKAGDRVTGLDIVKFKLYREQDGVCLYSGKGLDLQRLYEPGYADVDHIIPYSRCFDDSYSNKVLVLASENRQKGNCTPYEYFGENEQRWHEFSVRVGASVRDFKKRQKLLNTSFGEEQGKNFIQRNLNDTQHITRVVYNYLRNNLEFADSAYAKAPVQAVNGAVTAMLRGRWGIEKMRGDGDLHHCKDAVVIAATSPSMIQRLSNYYKEEERLFMGKTHFVDPGTGEVLTRKEFQQRFAPQFPQPWPRFREELEARLDPVNPTEALMALHLSTYEPEEEIKPVFVSHMPKRTVTGAAHEETIRSRTETGTVTKTALTALKLDKNGEIDGYYSPQTDPRLYRALVERLKQFGGEGTKAFAEPFYKPKKDGTPGPRVDKVKIERKSSLSVPTARGVAKNGDMIRMDVFRVPNERKSDDSYYFVPIYVADTKKATLPSKAVVKGKAPEAWKQMKPEHFLFSVFKGDLIYVESKKGISLALAKEAVGEKIIQVKSGLFYFCGADISDGSIKIETHDGRYYKKSLGIKELKAFEKRQVDVLGNVSKVRLPETRLEFRGRK

SEQ ID NO: 1652 - protein, 1061 aa, Unknown
  Description of Unknown: uncultivated organism with predicted taxonomy: Clostridiales bacterium 42_27
  MG21-142 effector
NYALLYQLDLNEWVWRKERDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1653 - protein, 1040 aa, Unknown
  Description of Unknown: uncultivated organism with predicted taxonomy: Clostridiales bacterium 42_27
  MG21-143 effector
RSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYWDERFWQKHPDGTRYHQTRNKAEDYRFTVERAAIVDEVRQIFAAQRRLGTVWMDEDMETDYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRKNRLSLTDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFVQPFYKPKKDGSPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRASGITVGAIQIETHDRRYLQPSLGIKTLQSIEKYQVDVLGNYYKVDLPEKRMTFSKEG

SEQ ID NO: 1654 - protein, 1098 aa, Unknown
  Description of Unknown: uncultivated organism with predicted taxonomy: Clostridiales
  MG21-144 effector
LSLRYTLGLDIGIASVGWAVLENNIDGEPIKIERLGVRIFDKAEQPKTGASLAEPRREARGQRRTIRRRRHRKDRIKQLIQQNGIMTRVEMAEMFEHLQFETSVYELRVQALERALTKQEFVRVLIHLAQRRGYKSNSKSEEAKDKENGKVKSAISENKKCMEENGYRTIGEMLLNDDRFWECNPDGIKIFVPHNHPDDYRTTVERSMVEDEIQLIFSRQRALGVPYATSEFEEAYLEIWGSQRNFDEGPGGKSPYGGNMIEKMLGHCTFEKDEPRAAKGSYSAEYFRLLQDVNHLRLVKNNGESCALTREQKQIYIDLVMKSAAASYAQLRKKLELSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSVKALRKLIPYLEKGMTYAEACKEVYGEQKSSITKKNKLSLFDIEPINNPVVRRAVSQTIRVINAVVREYGAPEVVRVELAREMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWKRFETLVNTQVHNWKKKRNLLTQVLSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKQVFVSRKQTHKISGAAHEATIRSAKKPGGSISKKPLTSLSLNKKTGEIKDYYAPESDRLLYEALKKRLEEFDGNAEKAFAEPFYKPKHDGTRGPLVKKVKIYEKKTITVPVGGGNADNGSMIRVDVFYMEDDGYYYVPIYTADVIKDELPNKAVVQKKLPEDWKEMDDKDFLFSMYPNELLYIEHRKGIKLKTKKGSSRQEQIVRKAGFYYFKGLNIAANALFIITHDNGYEQPSLGGKTLSCLKKYTVDALGNYSEVSLPEKRKPLRG

SEQ ID NO: 1655 - protein, 1096 aa, Unknown
  Description of Unknown: uncultivated organism with predicted taxonomy: Clostridiales
  MG21-145 effector
MEGFRYSLGLDIGIASVGFAVIQNDRNGEPIKIERLGVRVFDRAEQPKTGASLALPRRQARGSRRVIRRRRHRKERIKWLIEDSGLMSRPEQDALLGSGAFDKSVYELRVDALDRRLADDEAVRLLIHFAQRRGYKSNSKAEEAKEAAESGKVKSAISANRQRMEENGYRTVGEMLWRDPLFKRTEPDGRQILVVHNQPGEYKVTVERSMLLEELALIFVRQRELGAPWASEQFEVAYTDIWSSQRNFDDGPGGDSPYGGSQISRMLGKCIFEKELDRAPRASFSAEYFRLLQTANNLKIVGRGQPSEFLDEEQRKLFVELAFSSAAATYTQLRKKLDLPDDLYFNHLYYGEKSKEEIEKKKLGMLPFYHRLRTALNKVEKGAIDQLTAAQRDDIAMILLLYKSDDNRTLRLRDAGIPEEYIPAILELSTAKAAHLSLKAMRKLLPYLEQGYTYDKACKEVYGSHDGKKETERTGRLRLDMTDEITNPVVRRAVSQSIKVINAVVRVYGPPETVRIELARELGKTFDERSKQEKRINENAARNEQAREQIREYKSGDSTGLDIVKFKLFQEQNGVCLYSGKNLDISRLFEAGYVDVDHIIPYSISFDDSYSNKVLVLAGENRQKGNRIPYQYFGNDRERWNRFETLVGTQIRSFKKRKNLLIRSLGEAQIEGFRQRNLVDTQYLSRVIFRLIDENMAFAETGNYKRKTQTVSGAITAQVRKRLGIDKIRENGDLHHAADAAVIACISPGMVHKVTNYAKRCELYRDGQGYIDYETGEVMTKEAFDEKYAPRFPEPWPMFRKELEARLSADPRAEIEHLNLPAYDSSDELRPVFVSRMPRHKVTGAAHMETVRSGKLEGKTVTKTALTDLKLVKGEIKGYYRPEDDPLLYDALKARLQAFGGDAKKAFAEPFHKPKHDGAPGPLVKKVKIMDASSLNVPVNGGIAANGSMVRVDVFRVEDDGYYFVPVYVSDTIRTRLPDRAVVANKPYSEWKVMRDEDFVFSLFPGDLIRIKNSRRIKLNAAKGSTGEPVKYVKDALFYFSGLNISTGALGIQLHDRSYGQTGLGGKTLSLIEKYQVDVLGNYAPVHLPEKRMGFR

SEQ ID NO: 1656 - protein, 1521 aa, Unknown
  Description of Unknown: uncultivated organism with predicted taxonomy: Bacteroidales
  MG22-1 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDRTSDFLTTKKKEELYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVTKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTIFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGSNTRKRNIMLADEITEEFSHRQLNDTRYIARFMKGILSNIVREKNAEGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1657 - protein, 1542 aa, Unknown
  Description of Unknown: uncultivated organism with predicted taxonomy: Bacteroidales
  MG22-3 effector
MKNILGLDLGTNSIGWAWIQSKVPQQTDDCPSSSEYLMPDCATIRMAGSRVLPMDGKMLSGFESGLAVSKTKERTTYRMARRVNERFQLRRERLNRVLRILGFLPAHYEACLDRYGKIDEEKNVTIPWVPTADGKRKFLFYASFLEMKERFHEHHPNLEKIPLDWTLYYLRTKALQQAITKEELAWVLHSFNQKRGYNQSRDEVKDEDASQKEEYVKVKVVSVVDSGEKKKGKTSYIVTTESNLQFTTENAAAPSWLDKEREFIVTTKLNPTGLPKMNQEGRIDCTVRIPKEEDWELKKKRTEALIADSHMTVGEYIFHSLLDNPDAKIKGAKVGTIDRHFYKEELIAILKKQAAFHPELKDAERYAECVSALYASNEMHRNILSAWDMPRLIVNDIIFYQRPLKSKKSDIAECPFESRYFMDKEKKLQKQGIKCIPTSHPHFQEYRIWQFLSNLRVLRREVRENGRYMTDVDVSAHYLTDKVKVELYEWLAGKANVKQKELLSKLRMSEKEFRWNYVEDNIYPCGETRSLLSTRLKKAKLPLSLLDSPSSDGSHTFEFELWHILYSVSDLAELRKALRRFARKHDFTAEQQEAFVETFVKCPPFKKDYGAYSDKALVKLLSLMRIGKYWNADRIDTNTRRRIACLLDGEACDSISLRTREKVAERGLQQSIEQFQGLPQSLACYVVYDRHAEASEVVRWESPADLQQFTRQFKQYSLRNPIVEQVVLETLRVVHDLWEEIQKDGGTIDEIHLEMGRDLKNTAEQRARIMRRNRENEMTNFRIKLLLQELHDCQPDIEGIRPYSPSQQELLRLYEETVWESESGKLGGKEASKDIPDDIKKIRDLLSKPSDKPIPQSAIQRYRLWLDQKYLSPYTGRPIPLARLFTADYEIEHIIPRSIFFDDSYANKVICESAVNKLKNNRLGMQFIREMDGRVETVKLGEGRETSILSVDGYVDLVNDLFRNNPRKRNNLLAEEITEDFCHRQLSDTRYIARYIKGILSNIVRQRAADGTLEQEATSKNLIVCTGQITDRVKQDWGLNDVWNHIITPRFERLNRMTGSNDYGEWCCKEGKRYFQTRVPLHLQIGFNKKRIDHRHHAMDAIAIACVNRNVVNYLNNAAAHATDRMDLRMRICRPSGNGQTKKEIRSPWKNFAHDAECALQAITVSFKQNVRIITKATNTYEGYDASGKKVRRCQTSSDHYSIRKPLHKDTVYGEVVLPVVNQVPLKKALLRVNRIVNGKLRKKIQEMQSSGLTDKQIVDFFMKTCADSPEWNSINFKKIEVRAYSNEEGQTRMAAIRTAIDESFSEKVIGSITDVSIQRILLNHLRECNGDSEEAFSPEGIETMNRNIVRLNGGKPHLPIYKVRLGEAMGKKFAVGQRGNKGKKFVITAKNTNLFFAVYANDEGKRSFETIDLHCALEMQKQGSSVAPPINENGDKLLFVLSPNDLVYVPSESELQHDIDSEDLKLDHVFKVVSFSENRCCFVPHSMSSPIAAGFEFNSPNKIEVVSRLGLFEQDKETVSIKNICLPIKMDRLGHLHLVKI

SEQ ID NO: 1658 - protein, 1542 aa, Unknown; identical to SEQ ID NO: 1657
  Description of Unknown: uncultivated organism with predicted taxonomy: Bacteroidales
  MG22-4 effector

SEQ ID NO: 1659 - protein, 1521 aa, Unknown
  Description of Unknown: uncultivated organism with predicted taxonomy: Bacteroidales
  MG22-5 effector
MTKSTRNIIGLDLGTNSIGWSWIQQLISPTPTQPSEYIFDGTPIIRMSGSRIIPMPGDVTGSFERGETISKTKDRTANRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKIGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIIDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILPSIASVNLKKALLKADRILDKRLKDKIFELRKLYNYSNKQIEEHLTKVCINRPEWKNYDFKKIAVRILSNDADATHIVAIRKPLDETFDEEKIKAITDTGIQKILLNHLRQNDNDPKKAFTPEGIENMNANIVLLNGGKQHLPIYKVRISEKNNGGYFPIGQKGNRSQKYVTTAKDTNLFFAVYADSKGKRSFNMIDLRTAIECRKQGLSVAPSINEKGEKLLFTLSPNDLVYMPSEEEEANGFSIKGNLIKEHIYKMVSATNRQCFFIPHTVADFISRGQEYNVLNKIELAEDGRSIKEHCVPIKVNRLGK

SEQ ID NO: 1660 - protein, 1467 aa, Unknown
  Description of Unknown: uncultivated organism with predicted taxonomy: Bacteroidales
  MG22-6 effector
MTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESDTTIAWRSKEDGKNEFIFYPSFLEMASIFKEHHPDIQRIPLDWTLYYLRSKALHQAITKEELSWVLHSFNQKRGYYQSREDITEEEIIVTTSLDTSGKPKLDKEGKIIQSAKTPDEKDRTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAERDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSDIDVRVREKVAKAELCESIGQYQGLQQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWLQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEDFSHRQLNDTRYIARFMKGILSNIVRKKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1661 - protein, 1521 aa, Unknown; identical to SEQ ID NO: 1659
  Description of Unknown: uncultivated organism with predicted taxonomy: Prevotella
  MG22-7 effector

SEQ ID NO: 1662 - protein, 1521 aa, Unknown
  Description of Unknown: uncultivated organism with predicted taxonomy: Bacteroidales
  MG22-8 effector
MTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESDTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFANGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAERDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSDIDVRVREKVAKAELCESIGQYQGLQQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWLQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEDFSHRQLNDTRYIARFMKGILSNIVRKKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1663 - protein, 1524 aa, Unknown
  Description of Unknown: uncultivated organism with predicted taxonomy: Bacteroidales
  MG22-9 effector
MTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQPRKDITEKEKTKKIEYIKDIVRSVEDTGEKTKGKKAYKVTFDNGFKFISTEAEAPLWVGRTREVIVTTSLDATGAPKRDKEGNIIQSVKAPEEKDWTLKKIRTENHIDKSKLTVGEYILQTLLEKPNTKIKGAHVSTIDRRFYIHEINAILKVQEKYHKELRDKSLYEQCTQALYTQNEVRRNIIAPWSMSDLLIKDILFYHRPLKSKKSQISECPFEFHNYTDKNGASHRQGIKCIPTSHPLFQEYRIWQFIANLRIYERERFDNGKHLINENKTSEFLTSEKKEELFEWLAEKDSVSQKTLLGHIGLKVEHYHWNFPEEKTYPCGETRHLIQSRLKKANLLKSFCSLVPENQKKEFELKLWHILYSVSDYNELRKALETFARKTGFTREEQDLFVEFFSSCPPFKKVYGAYSKRAIARLLPLMRLGKYWHEEHIDSATMNRIEHLISGEECNGIDVRVRENIAKFGLNESIEQYQGLPQWLACYVVYNRHSEASEVTKWESPEELDNYIKAFKQYSLRNPIVEQISLETLRVVHDLWAEIQKEGQTIDEIHLEMGRDLKNTAEERSRIFRRNSENEDTNFRIKLLLEEFYTNEEDMEGIRPYSPSQQELLRIYEEGVWQQEKEIPQDIKDIKKKLSSDKDINEITHSDVQRYRIWMDQKYCSPYTGNPIPLSRLFTPDYEIEHVIPRSRYFDDSYNNKVICEAAVNKDKNNRLGMEYIMEAGGKTIELGNGKNVQVLKEREYVELVNEVFKNNTRKRNILLADEIPEDFSHRQLNDTRYIARFMKGFLSNIVREKNADGTLELEETSKNLIVCSGRITDRIKQDWGLNDVWNHIITPRFERLNQKTSSDNFGEYVCKEGKRYFQTRVPLNLQKGFNKKRIDHRHHAMDAIAIACVNRSIVNYLNNAAANQTEREDLRRAVCIPERNGQTKRQLRSPWRNFAKDAENALRQIVVSFKQNLRILTKATNSYECFDTTSGKKIRRHQVNEEHYTVRKPLHEDFVYGEVILSSIASVNFKKALQKANRILDKRLKDKIFELRKLYSYSNKQIEEHLTKVCINTPEWKDYDFKKINIRILSNDEGATHIVAIRKPLDESFDKVKINTITDTGIQKILLNHLSRYAEDPKKAFSLEGIEDMNANITSLNGGKQHLPIYKVRVSEKDNGGYYPIGQKGNRSKKYVTTAKDTNLFFAVYADSNGKRSFKTIDLRTAIECKKQGLSVAPSVNEKGEQLLFTLSPNDLVYMPSEEEEANGFAIDNNLNKEHIYKMVSTDSNRCFFIPHTVADFISRGEEYNRHNKIELTEDRRSIKEHCVPLKVNRLGKKTL

SEQ ID NO: 1664 - protein, 1521 aa, Unknown
  Description of Unknown: uncultivated organism with predicted taxonomy: Bacteroidales
  MG22-10 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRAFKQYSLRNPIVEQVSLETLRVVRDLWAELQKECQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRIATKATNSYECFDTASGKKIRKHQSNREHYAIRKPLHKDSVYGEVILPSIASVNLKKALLKADRILDKRLKDIIFELRKLYNYSNKQIEEHLTKVCINRPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNDLNKEQIYKMVSATNNRCFFIPHTVADFISRGQEYNSVNKIELTEDGRSIKEHCVPLKVNRLGK

SEQ ID NO: 1665 - protein, 933 aa, Unknown
  Description of Unknown: uncultivated organism with predicted taxonomy: Prevotella
  MG22-11 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASKLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVL

SEQ ID NO: 1666 - protein, 1102 aa, Unknown
  Description of Unknown: uncultivated organism with predicted taxonomy: Prevotella sp. MGM2
  MG22-12 effector
LYSSHHVAANSTYPFKTGHNRTPLNPFTTHKTQPYNIMTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELNNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYF

SEQ ID NO: 1667 - protein, 1558 aa, Unknown
  Description of Unknown: uncultivated organism with predicted taxonomy: Prevotella
  MG22-13 effector
LYSSHHVAANSTYPFKTGQNRTPLNPFTTHKTQPYNIMTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHEELRDKSLYEQCIKALYAQNEVRRNIIAPWSMSDLLIKDILFYHRPLKSKKSQISECPLEFHCYTDKDGETHRQGIKCIPVSHPLFQEYRIWQFISNLRIYEREHFDNGKHFTNVDKTSDFLTSEKKEELYEWLAEKDSVSQKTLLGHLGLKVERYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLENTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLSLQKGFNKKRIDHRHHAMDAIAIACVNRSIVNYLNNAAANQTEREDLRRAVCIPERNGQTKRQLRSPWLCFARDTENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINRPEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKDTNLFFAVYANSNGKRCFKTIDLRTAIECKKQGLSVAPSVNEKGDKLLFTLSPNDLVYMPSEEEEANGFSIKGNLIKEHIYKMVSANDNRCFFIPHTVVDFISNGEEYNRHNKIELTEDRRSIKEHCVPLKVNRLGK

SEQ ID NO: 1668 - protein, 781 aa, Unknown
  Description of Unknown: uncultivated organism with predicted taxonomy: Bacteroides ndongoniae
  MG22-14 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLNKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAERDSVSQKTLLGKIGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTN

SEQ ID NO: 1669 - protein, 822 aa, Unknown
  Description of Unknown: uncultivated organism with predicted taxonomy: Prevotella sp. MGM2
  MG22-15 effector
KWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRQKKYVTTAKDTNLFFAVYADSKGKRSYKTIDLRTAIECRKQGLSVAPSVNEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1670 - protein, 1521 aa, Unknown
  Description of Unknown: uncultivated organism with predicted taxonomy: Prevotella sp. MGM2
  MG22-16 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYCKRAITKLLPLMRIGKFWHEESIDTTTKTRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLKNTAEERSKIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFAREAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKNNGGYFPIGQKGNRHKKYVTTAQDTNLFFAIYADSKGKRSYKTIDLRTAIECRKQGLSVAPSINEKGDKLLFTLSPNDLVYMPSEGEETNGFAIDNNLNKEQIYKMVSATNNRCFFIPHTVADFISRGQEYNSVNKIELTEDGRSIKEHCVPLKVNRLGK

SEQ ID NO: 1671 - protein, 1187 aa, Unknown
  Description of Unknown: uncultivated organism with predicted taxonomy: Prevotella
  MG22-17 effector
VSTIDRRFYINEINAILKEQEKYHEELRDKSLYEQCIKALYAQNEVRRNIIAPWSMSDMLIKDILFYHRPLKSKKSHISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETKHLIQSRLKKANLQKAFHSLISDEQKDCFERGLWHILYSVSDYNELCKALKTFARKTEFTLEEQFLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNTDGILEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEEKIKTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECKKQGLSVAPSVNEKGDKLLFTLSPNDLVYMPSEEEEANGFSIKGNLIKEHIYKMVSANNRQCFFIPHSVADFISKGEEYNAHNKIELAEDGRSIKVHCVPLKVNRLGK

SEQ ID NO: 1672 - protein, 1283 aa, Unknown
  Description of Unknown: uncultivated organism with predicted taxonomy: Bacteroidales
  MG22-18 effector
VTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYCKRAITKLLPLMRIGKFWHEESIDTTTKTRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLKNTAEERSKIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFAREAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKNNGGYFPIGQKGNRHKKYVTTAQDTNLFFAIYADSKGKRSYKTIDLRTAIECRKQGLSVAPSINEKGDKLLFTLSPNDLVYMPSEGEETNGFAIDNNLNKEQIYKMVSATNNRCFFIPHTVADFISRGQEYNSVNKIELTEDGRSIKEHCVPLKVNRLGK

SEQ ID NO: 1673 - protein, 1521 aa, Unknown
  Description of Unknown: uncultivated organism with predicted taxonomy: Prevotella
  MG22-19 effector
MTKNTRNIIGLDLGTNSIGWSWIQQLISPTSTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGKYIFHALLKNPETKIKGAHVSTIDRRFYINEINAILKEQEKYHKELRDKSLYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHFINEDKTSDFLTTKKKEKLYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWPCFARDAENALRQIVVSFKQNLRVATKATNSYECFDTASGKKIRRHQSNREHYAIRKPLHKDSVYGEVILTSIASVNLKKTLLKAERILDKRLKDKIFELRKLYNYSNKQIEEHLTKVCINRPEWKNYDFKKIAVRILSNDADATHIVAIRKPLDETFDKEKIKTITDTGIQKILKNHLSRYANDPKKAFSPEGIEDMNANIASLNGGKQHLPIYKVRVSEKDNGGYFPIGQKGNRQKKYVTTAKDTNLFFAVYADSKGKRSYKTIDLRTAIECRKQGLSVAPSINEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1674 - protein, 921 aa, Unknown
  Description of Unknown: uncultivated organism with predicted taxonomy: Prevotella sp. MGM2
  MG22-20 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLRVGEYIFHALLKNPETKIKGAHVSTIDRRFYINEINAILKEQEKYHEELRDKSIYEQCTQALYAQNEVRRNIIAPWSMKDLLTKDILFYHRPLKSKKSQISECPLEFHTYTDKDGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLIPDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIM

SEQ ID NO: 1675 - protein, 1521 aa, Unknown
  Description of Unknown: uncultivated organism with predicted taxonomy: Bacteroidales
  MG22-21 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLKNPETKIKGAHVSTIDRRFYINEINAILKEQEKYHEELRDKTIYEQCIKALYAQNEVRRNIIAPWSMKDLLTKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAELCESIEQYQGLPQWLANYVVYNRHSEASEITKWESPDELDKYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTGIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILKNHLSRYAKNPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1676 - protein, 1420 aa, Unknown
  Description of Unknown: uncultivated organism with predicted taxonomy: Bacteroidales
  MG22-22 effector
MGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEITAILKEQEKYHEELRNKSLYEQCTQALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLENTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALQQIVVSFKQNLRVATKATNSYECFDTASGKRIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILKNHLSQNDNDPKKAFTPEGIENMNANIVLLNGGKQHLPIYKVRISEKNNGGYFPIGQKGNRHKKYVTTAQDTNLFFAVYVDSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1677 - protein, 1533 aa, Unknown
  Description of Unknown: uncultivated organism with predicted taxonomy: Bacteroidales
  MG22-23 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCSETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEVVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEKGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGANKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNILTRHLKACNGDSKIAFSPQGVEEMNQHLAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1678 - protein, 1521 aa, Unknown
  Description of Unknown: uncultivated organism with predicted taxonomy: Bacteroidales
  MG22-24 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHFINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKIAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLANEITEEFSHRQLNDTRYIARFMKGILSNIVREKNADGTLEPEETSKNLIVCSGRITDRVKQDWGLNDIWNHIITSRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKDKIFELRKLYNYSNKQIEEHLTKVCINCLEWKNYDFKKIAVRILSNDADATHIVAIRKPLDESFDEVKINTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1679 - protein, 821 aa, Unknown
  Description of Unknown: uncultivated organism with predicted taxonomy: Prevotella sp. MGM2
  MG22-25 effector
AGLCESIEQYQGLPQWLANYVVYNRHSEASEIIKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKEQIYKMVSATNNRCFFIPHTVADFIS

SEQ ID NO: 1680 - protein, 1521 aa, Unknown
  Description of Unknown: uncultivated organism with predicted taxonomy: Bacteroidales
  MG22-26 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAEKDSVSQKTLLGKIGLKVEHYHWNYPEEKTYPCGETRHLIQSRLKKANLQKAFHSLISDEQKDCFERGLWHILYSVSDYNELCKALKTFARKTGFTLEEQLLFVEVFSSCPPFKKDYGAYSKRAITKLLPLMRIGKFWHEESIDSTTKNRIEHLISGEECSGIDVRVREKVAKAGLCKSIEQYQGLQQWLANYVVYNRHSEASEITKWESPDELDNYIRSFKQYSLRNPIVEQVSLETLRVVRDLWAELQKEDQTIDEIHLEMGRDLKNTAEERSRIFRRNNENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSINEKGDKLLFTLSPNDLVYMPSEWEEANGFAIDNNLNKEQIYKMVSATNNRCFFIPHTVADFISRGEEYNSHNKIELTEDGRSIKEHCVPLKVNRLGK

SEQ ID NO: 1681 - protein, 1200 aa, Unknown
  Description of Unknown: uncultivated organism with predicted taxonomy: Prevotella sp. MGM2
  MG22-27 effector
LLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1682 - protein, 822 aa, Unknown; identical to SEQ ID NO: 1669
  Description of Unknown: uncultivated organism with predicted taxonomy: Bacteroidales
  MG22-28 effector

SEQ ID NO: 1683 - protein, 1521 aa, Unknown
  Description of Unknown: uncultivated organism with predicted taxonomy: Bacteroidales
  MG22-29 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKELHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHSPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHKESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKAERIIDKRLKDKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1684 - protein, 751 aa, Unknown
  Description of Unknown: uncultivated organism with predicted taxonomy: Prevotella sp. MGM2
  MG22-30 effector
FRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIIVSFKQNLRVATKATNSYECFDIASGKKIRKHQSNREHYAIRKPLHKDSVYGEVILPSIASVNLKKALLKADRILDKRLKEKIFELRKLYNYSNKQIEEHLTKVCINRPEWKNYDFKKIAVRILSNDADATHIVAIRKPLDETFDEDKIKTITDTGIQKILLNHLRQNDNDPKKAFTPEGIENMNANIVLLNGGKQHLPIYKVRISEKNNGGYFPIGQKGNRSQKYVTTAKDTNLFFAVYADQKGKRSFKTIDLRTAIECRKQGVSVAPSINEKGDKLLFTLSPNDLVYMPSEEEEANGFSIKGNLIKEHIYKMVNASNNRCFFIPHSVADFISKGEEYNALNKIELTEDGRSIKVHCVPLKVNRLGK

SEQ ID NO: 1685 - protein, 1521 aa, Unknown
  Description of Unknown: uncultivated organism with predicted taxonomy: Bacteroidales
  MG22-31 effector
MTKNTRNIIGLDLGTNSIGWSWIQQLISPTPTQASEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTREKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHSPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILPSIASVNLKKALLKADRILDKRLKEKIFELRKLYNYSNKQIEEHLTKVCINCLEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFDMIDLRTAIECWKQGVSVAPSMNEKGDKLLFTLSPKDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1686 - protein, 808 aa, Unknown
  Description of Unknown: uncultivated organism with predicted taxonomy: Bacteroidales
  MG22-32 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIDCKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRRALKNLSNSK

SEQ ID NO: 1687 - protein, 1521 aa, Unknown; identical to SEQ ID NO: 1685
  Description of Unknown: uncultivated organism with predicted taxonomy: Bacteroidales
  MG22-33 effector

SEQ ID NO: 1688 - protein, 797 aa, Unknown
  Description of Unknown: uncultivated organism with predicted taxonomy: Bacteroidales
  MG22-34 effector
QTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNIFTRHLKACNGDSKIAFSPQGVEEMNQHIAELNNGNAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1689 - protein, 833 aa, Unknown
  Description of Unknown: uncultivated organism with predicted taxonomy: Parabacteroides sp. An277
  MG22-35 effector
MPLRETNFQMQGIKCIPVSNPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHSNERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKK

SEQ ID NO: 1690 - protein, 1533 aa, Unknown
  Description of Unknown: uncultivated organism with predicted taxonomy: Bacteroidales
  MG22-36 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCSETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEVVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEKGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMTFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGANKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNILTRHLKACNGDSKIAFSPQGVEEMNQHLAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1691 - protein, 1502 aa, Unknown
  Description of Unknown: uncultivated organism with predicted taxonomy: Bacteroidales
  MG22-37 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESDTTIAWRSKEDGKNEFIFYPSFLEMASIFKEHHPDIQRIPLDWTLYYLRSKALHQAITKEDLSWVLHSFNQKRGYYQSREDITEEDKTKKVEYIKGVVNSVEDTGEKAKGKKIYKVTFANGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAVHSLISDEQKECFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDTYNNKVICESAVNKDKNNRLGMEYIMAAGGKTIELGNGKNVQILKEEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENVLRQIVVSFKQNLRVATKATNSYECFDTTSGKKIRKHQSNREHYAIRKPLHKDSVYGEVILTSIASVNLKKALLNAERILDKRLKEKIFELRKLYNYSNKQIEEHLTKVCINCPEWKNYDFKKIAVRILSNDADATHIVAIRKPLDETFDEDKIKTITDTGIQKILLNHLRQNDNDPKKAFTTEGIENMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEEANGFSIKGNLIKEHIYKMVSANDNRCFFIPHTVAEYCIFLYVFLRLCGQIKEH

SEQ ID NO: 1692 - protein, 1521 aa, Unknown
  Description of Unknown: uncultivated organism with predicted taxonomy: Prevotella
  MG22-38 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRMPLSLQKGFNKKRIDHRHHAMDAIAIACVNRSIVNYLNNAAANQTEREDLRRAVCIPERNGQTKRQLRSPWHCFARDAENALRQIVVSFKQNLRIATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRPKKYVTTAKDTNLFFAVYVDSKGKRSYKTIDLRTAIECKKQGLSVAPSVNEKGDKLLFTLSPNDLVYMPSEEEEANGFSIKGNLIKEHIYKMVSANDNRCFFIPHTVADFISNGEEYNRHNKIELTEDRRSIKEHCVPLKVDRLGK

SEQ ID NO: 1693 - protein, 1558 aa, Unknown
  Description of Unknown: uncultivated organism with predicted taxonomy: Prevotella sp. MGM2
  MG22-39 effector
LYSSHHVAANSTYPFKTGHNRTPLNRFTTHKTQPYNIMTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKIIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHFINEDKTSDFLTTKKKEELYEWLAERDSVSQKTLLGKIGLKVEHYHWNYPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEIIKWESPDELDNYIRSFKQYSLRNPIVEQVSLETLRVVRDLWTELRKEGQTIDEIHLEMGRDLKNTAEERSRIFKRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNSGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKEQIYKMVSANNKQCFFIPHTVADFISRGEEYNSHNKIELTEDRRSIKEHCVPLKVNRLGK

SEQ ID NO: 1694 - protein, 1532 aa, Unknown
  Description of Unknown: uncultivated organism with predicted taxonomy: Bacteroidales
  MG22-40 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASKLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLSESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNILTRHLKACNGDSKIAFSPQGVEEMNQHIAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1695 - protein, 1521 aa, Unknown
  Description of Unknown: uncultivated organism with predicted taxonomy: Bacteroidales
  MG22-41 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKAWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETKHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDIRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALQQIVVSFKQNLRVATKATNSYECFDTASGKKIRKHQSNREHYAIRKALHKDSVYGEVILTSIASVYLKKALLKAERILDKRLKEKIFELRKLYNYSNKQIEEHLTKVCINCPEWKNYDFKKIAVRILSNDADATHIVAIRKPLDETFDKEKIKAITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1696 - protein, 1521 aa, Unknown; identical to SEQ ID NO: 1678
  Description of Unknown: uncultivated organism with predicted taxonomy: Prevotella
  MG22-42 effector

SEQ ID NO: 1697 - protein, 1423 aa, Unknown
  Description of Unknown: uncultivated organism with predicted taxonomy: Bacteroidales
  MG22-43 effector
MGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQPRKDITEKEKTKKIEYIKDIVRSVEDTGEKTKGKKAYKVTFDNGFKFISTEAEAPLWVGRTREVIVTTSLDATGAPKRDKEGDIIQSVKAPEEKDWTLKKIRTENHIDKSKLTVGEYILQTLLEKPDTKIKGAHVSTIDRRFYIHEINAILKVQEKYHKELRDKSLYEQCTQALYTQNEVRRNIIAPWSMSDLLIKDILFYHRPLKSKKSQISECPFEFHNYTDKNGASHRQGIKCIPTSHPLFQEYRIWQFIANLRIYERERFDNGKHLINENKTSEFLTSEKKEELFEWLAEKDSVSQKTLLGHIGLKVEHYHWNFPEEKTYPCGETRHLIQSRLKKANLLKSFCSLVPEKQKKEFELKLWHILYSVSDYNELRKALETFARKTGFTREEQDLFVEFFSSCPPFKKVYGAYSKRAIARLLPLMRLGKYWHEEHIDSATMNRIEHLISGEECNGIDVRVRENIAKFGLNESIEQYQGLPQWLACYVVYNRHSEASEVTKWESPEELDNYIKAFKQYSLRNPIVEQISLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKDVQILKEEEYVELVDKIFGNNTRKRNIMLADEITEEFSHRQLNDTRYIARFMKGILSNIVREKNADGTLESEETSKNLIVCSGRITDRVKQDWGLNDIWNHIITPRFERLNTKTSSDKFGEYVCKEGKRYFQTRVPLNLQKGFNKKRIDHRHHAMDAIAIACVNRSIVNYLNNAAANQTEREDLRRAVCIPERNGQTKRQLRSPWRNFAKDAENALRQIVVSFKQNLRILTKATNSYECFDTTSGKKIRRHQVNEEHYAVRKPLHEDFVYGEVILSSIASVNFKKALQKANRILDKRLKDKIFELRKLYSYSNKQIEEHLTKVCINTPEWKDYDFKKINIRILSNDEGATHIVAIRKPLDESFDKVKINTITDTGIQKILLNHLSRYAEDPKKAFSLEGIEDMNANITSLNGGKQHLPIYKVRVSEKDNGGYYPIGQKGNRSKKYVTTAKDTNLFFAVYADSNGKRSFKTIDLRTAIECKKQGLSVAPSVNEKGEQLLFTLSPNDLVYMPSEEEEANGFAIDNNLNKEHIYKMVSTDSNRCFFIPHTVANFISRGEEYNRHNKIELTEDRRSIKEHCVPLKVNRLGKKTL

SEQ ID NO: 1698 - protein, 1521 aa, Unknown
  Description of Unknown: uncultivated organism with predicted taxonomy: Bacteroidales
  MG22-44 effector
MTKNTRNIIGLDLGTNSIGWSWIQQLISPTPTQPSEYLFDGTPIIRMSGSRIIPMHGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINRPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKNNGGYFPIGQKGNRPKKFVTTAQDTNLFFAVYADSKGKRSFKTIDLRTAIECKKQGLSVAPSVNEKGDKLLFTLSPNDLVYMPSEEEEANGFAIKGNLIKEHIYKMVNASNNRCFFIPHSVADFISKGEEYNALNKIELTEDGRSIKVHCVPLKVNRLGK

SEQ ID NO: 1699 - protein, 1521 aa, Unknown
  Description of Unknown: uncultivated organism with predicted taxonomy: Bacteroidales
  MG22-45 effector
MTKNTRNIIGLDLGTNSIGWSWIQQLISPTPTQPSEFLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKQTVGEYIFHALLKNPETKMKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKDCFERSLWHILYSVSDYNELCKALKTFARKTGFTLEEQSLFGEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLHIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEEKIKTITDTGIQKILLNHLSRYADDPKKAFSPEGIEDMNANIASLNGGKQHLPIYKVRVSEKDNGGYFPIGQKGNRPKKYVTTAQDTNLFFAVYADSKGKRSYKTIDLRTAIECRKQGLSVAPSINEKGDKLLFTLSPNDLVYMPSEGEEANGFAIDNNLNKEQIYKMVSANNKQCFFIPHTVADFISNGEEYNRHNKIELTEDRRSIKEHCVPLKVNRLGK

SEQ ID NO: 1700 - protein, 1532 aa, Unknown
  Description of Unknown: uncultivated organism with predicted taxonomy: Bacteroidales
  MG22-46 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFTKVAVRVWSNDEEGSRMVSVRKAIDESFDMKQIEKVYDPIVRNILTRHLKACNGDSKIAFSPQGVEEMNQHIAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1701 - protein, 1521 aa, Unknown
  Description of Unknown: uncultivated organism with predicted taxonomy: Bacteroidales
  MG22-47 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISDCPLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRAFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEATVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1702 - protein, 1532 aa, Unknown; identical to SEQ ID NO: 1700
  Description of Unknown: uncultivated organism with predicted taxonomy: Bacteroidales
  MG22-48 effector

SEQ ID NO: 1703 - protein, 1521 aa, Unknown
  Description of Unknown: uncultivated organism with predicted taxonomy: Bacteroidales
  MG22-49 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCKSIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFAKDAENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINRPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEEANGFSIKGNLIKEHIYKMVSANDNRCFFIPHTVADFISNGEEYNRHNKIELTEDRRSIKEHCVPLKVNRLGK

SEQ ID NO: 1704 - protein, 1521 aa, Unknown
  Description of Unknown: uncultivated organism with predicted taxonomy: Bacteroidales
  MG22-50 effector
MTKNTRNIIGLDLGTNSIGWSWIQQLISPPPTQPSEYLFDGTPIIRMSGSRIIPMPGDVTGSFERGETISKTKDRTAKRMARRMNERFQLRRERLNRVLNIMGFLPGHYARALDRYGKLNEESNTTIAWRSKEDGNNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQKEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1705 - protein, 1301 aa, Unknown
  Description of Unknown: uncultivated organism with predicted taxonomy: Prevotellaceae
  MG22-51 effector
LVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCNRQLTDTRYIARFMMGVLSNIVRQNDNGVLESEAISKNLIVCNGKITDRVKQDWGLNDVWNHIVTPRFERLNQITNSSDFGEWCNKEGKRYFQTRIPLELQKRVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAVDESFDMKQIEKVYDPIVRNILTRHLKACNGDSKTAFSPQGVEEMNQHIAELNNENAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1706 - protein, 941 aa, Unknown
  Description of Unknown: uncultivated organism with predicted taxonomy: Prevotella sp. MGM2
  MG22-52 effector
MTKNTRNIIGLDLGTNSIGWSWIQQLISPPPTQPSEYLFDGTPIIRMSGSRIIPMPGDVTGSFERGETISKTKDRTAKRMARRMNERFQLRRERLNRVLNIMGFLPGHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLYNPQNEAFRLSITNRIISYSSFGFRL

SEQ ID NO: 1707 - protein, 1521 aa, Unknown
  Description of Unknown: uncultivated organism with predicted taxonomy: Bacteroidales
  MG22-53 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLISDEQKECFERGLWHILYSISDYNELCKALKTFARKTGFKLEEQLLFVEAFSSCPPFKKDYGAYSKRAITKLLPLMRIEKFWHEESIDSTTKNRIEHLISGEECSGIDVRVREKVAEAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEATVNKDKNNRLGMEYIMAAGGKTIELGNGKNVQILKEEEYVELVDKIFGNNTRKRNIMLTDEITEEFSHRQLNDTRYIARFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKADRILDKRLKDKIFELRKLYNYSNKQIEEHLTKVCINCLEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVSPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1708 - protein, 1569 aa, Unknown
  Description of Unknown: uncultivated organism with predicted taxonomy: Bacteroidales
  MG22-54 effector
YGLLTHKQLCVLYSSHHVAANSTYPFKTGHNRTPLNRFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECPLEFHTYTDKNGVTHRQGIKCIPTSHPLFQEYRIWQFIANLRIYERERFDNGKHLINEDKTSDFLTTKKKEELYEWLAEKDSVSQKTLLGHLGLKVERYHWNYPEEKTYPCGETRHLIQSRLKKANLQKAFHSLISEEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRIREKVAKAGLCESIEQYQGLPLWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTKREDLRRAVCIPERNGQTKRQLRSPWPCFARDTENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1709 - protein, 1614 aa, Unknown
  Description of Unknown: uncultivated organism with predicted taxonomy: Bacteroidales
  MG22-55 effector
TNIFQKAKPFHNKFTTFVNVSIQRAVLEYQVGLYNNSFFKKATRCYGLLTHKQLCVLYSSHHVAANSTYPFKTGHNRTPLNRFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECPLEFHTYTDKNGVTHRQGIKCIPTSHPLFQEYRIWQFIANLRIYERERFDNGKHLINEDKTSDFLTTKKKEELYEWLAEKDSVSQKTLLGHLGLKVERYHWNYPEEKTYPCGETRHLIQSRLKKANLQKAFHSLISEEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRIREKVAKAGLCESIEQYQGLPLWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTKREDLRRAVCIPERNGQTKRQLRSPWPCFARDTENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1710 - protein, 1347 aa, Unknown
  Description of Unknown: uncultivated organism with predicted taxonomy: Bacteroidales
  MG22-56 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMAAIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHFINEDKTSDFLTTKKKEELYEWLAERDSVSQKTLLGKIGLKVEDYHWNFPEEKTYPCGETRHLIQSRLKKANLQKTFHSLISDEQKECFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRAFKQYSLRNPIVEQVSLETLRVVLDLWAELQKEGQTIDEIHLEMGRDLKNTAEERSRIFKRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEQEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWPCFARDTENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINRPEWKNYDFKKIAVRILSNDADATHIVAIRKPLDESFDKVKINTITDTGIQKILLNHLSRYADDPKKAFSPEGIEDMNANIASLNGE

SEQ ID NO: 1711 - protein, 1558 aa, Unknown
  Description of Unknown: uncultivated organism with predicted taxonomy: Bacteroidales
  MG22-57 effector
LYSSHHVAANSTYPFKTGHNRTPLNRFTTHKTQPYNIMTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLENPETKIKGAHVSTIDRRFYINEINAILKEQEKYHEELRDKSIYEQCIKALYAQNEVRRNIIAPWSMKDLLTKDILFYHRPFKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNYPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSRQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVYIPERNGQTKRQLRSPWHCFARDAENALRQIVVSFKQNLRVATKATNSYECFDTASGKKIRKHQSNREHYAIRKPLHKDSVYGEVILPSIASVNLKKALMKADRILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNSGKQHLPIYKVRVSEKDNGGYFPIGQKGNRPKKYVTTAKDTNLFFAVYADSKGKRSYKTIDLRTAIECRKQGLSVAPSVNQKGDKLLFTLSPNDLVYMPSEEEEVNGFAIDNNLNKDQIYKMVSANNKQCFFIPHTVADFISRGEEYNSHNKIELTEDRRSIKEHCVPLKVNRLGK

SEQ ID NO: 1712 - protein, 1558 aa, Unknown
  Description of Unknown: uncultivated organism with predicted taxonomy: Bacteroidales
  MG22-58 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMDRRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGETHRQGIKCIPVSHPLFQEYRIWQFISNLRIYEREHFDNGKHFTNVDKTSEFLTSEKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSYNTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1713 - protein, 1521 aa, Unknown
  Description of Unknown: uncultivated organism with predicted taxonomy: Bacteroidales
  MG22-59 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPIKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLENTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALQQIVVSFKQNLRVATKATNSYECFDTASGKRIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILKNHLSQNDNDPKKAFTPEGIENMNANIVLLNGGKQHLPIYKVRISEKNNGGYFPIGQKGNRHKKYVTTAQDTNLFFAVYVDSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1714 - protein, 1521 aa, Unknown
  Description of Unknown: uncultivated organism with predicted taxonomy: Bacteroidales
  MG22-60 effector
MTKNTRNIIGLDLGTNSIGWSWIQQLISPPPTQPSEYLFDGTPIIRMSGSRIIPMPGDVTGSFERGETISKTKDRTAKRMARRMNERFQLRRERLNRVLNIMGFLPGHYVRALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1715 - protein, 1521 aa, Unknown
  Description of Unknown: uncultivated organism with predicted taxonomy: Bacteroidales
  MG22-61 effector
MTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFANGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHFINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAHSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILMEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAIAIACVNRSIVNYLNNAAANQIEREDLRRAVCIPERNGQTKRQLRSPWHCFARDAENALRQIVVSFKQNLRIATKATNSYECFDTASGKKNRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNGGKQHLPIYKVRVSEKDNGGYFPIGQKGNRPKKYVTTAKDTNLFFAVYVDSKGKRSYKTIDLRTAIECKKQGLSVAPSVNEKGDKLLFTLSPNDLVYMPSEEEEANGFSIKGNLIKEHIYKMVSANDNRCFFIPHTVADFISNGEEYNRHNKIELTEDRRSIKEHCVPLKVDRLGK

SEQ ID NO: 1716 - protein, 1558 aa, Unknown
  Description of Unknown: uncultivated organism with predicted taxonomy: Bacteroidales
  MG22-62 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILKNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSTNEKGDKLLFTLSPNDLVYMPSEGEEANGFSIDNYLNKEQIYKMVSATYKQCFFIPHTVADFIYKNKEFNVLNKIELTEDRRSIKEHCVPLKVNRLGK

SEQ ID NO: 1717 - protein, 913 aa, Unknown
  Description of Unknown: uncultivated organism with predicted taxonomy: Parabacteroides
  MG22-63 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWYEESIDSTTKNRIEHLISGEECSSIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNN

SEQ ID NO: 1718 - protein, 1450 aa, Unknown
  Description of Unknown: uncultivated organism with predicted taxonomy: Prevotella sp. MGM2
  MG22-64 effector
MTKNIRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKQTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRSKKYVTTAKDTNLFFAVYANSNGKRSYKTIDLRTAIECKKQGLSVAPSVNEKGDKLLFTLSRRTRQTLWSRPCRC

SEQ ID NO: 1719 - protein, 1521 aa, Unknown
  Description of Unknown: uncultivated organism with predicted taxonomy: Prevotella
  MG22-65 effector
MTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLENPETKIKGAYVSTIDRRFYINEINAILKEQEKYHEELRDKSIYEQCIKALYAQNEVRRNIITPWSMKDLLTKDILFYHRPLKSKKSQISECPLEFHCYTDKDGETHRQGIKCIPVSHPLFQEYRIWQFISNLRIYEREHFDNGKHFTNVDKTSDFLTTKKKEELFEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRIREKVAKAGLCESIEQYQGLQQWLANYVVYNRHSEASEIIKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIIVSFKQNLRVATKATNSYECFDTASGKKIRKHQSNREHYAIRKPLHKDSVYGEVILTSIASVYLRKALLKAERILDKRLKEKIFELRKLYNYSNKQIEEHLTKVCINCPEWKNYDFKKIAIRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECRKQGLSVAPSINEKGEKLLFTLSPNDLVYMPSEEEEANGFSIKDNLIKEHIYKMVSATNRQCFFIPHTVADFISRGQEYNVLNKIELAEDGRSIKEHCVPIKVNRLGK

SEQ ID NO: 1720 - protein, 1053 aa, Unknown
  Description of Unknown: uncultivated organism with predicted taxonomy: Prevotella sp. MGM2
  MG22-66 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLEMLRVVRNLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCS

SEQ ID NO: 1721 - protein, 938 aa, Unknown
  Description of Unknown: uncultivated organism with predicted taxonomy: Bacteroidales
  MG22-67 effector
MTKNTRNIIGLDLGTNSIGWSWIQQLISPTPTQASEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETLRQGIKCIPVSHPLFQEYRIWQFISNLRIYEREHFDNGKHFTNVDKTSEFLTSEKKEELYEWLAERDSVSQKTLLGKIGLKVEDYHWNYPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTAKRYHCPVFSPPTTKSNTSFRVHGILTTPIIIRSSAKLPSTKTKTTDWAWNTSWLLEEKRLNSATGKTFKF

SEQ ID NO: 1722 - protein, 1521 aa, Unknown; identical to SEQ ID NO: 1714
  Description of Unknown: uncultivated organism with predicted taxonomy: Bacteroidales
  MG22-68 effector

SEQ ID NO: 1723 - protein, 1521 aa, Unknown
  Description of Unknown: uncultivated organism with predicted taxonomy: Bacteroidales
  MG22-69 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEITAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAITIACVNRSIVNYLNNAAANQTEREDLRRAVCIPERNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1724 - protein, 1520 aa, Unknown
  Description of Unknown: uncultivated organism with predicted taxonomy: Bacteroidales
  MG22-70 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVTIDRRFYINEINAILKEQEKYHEELRDKSIYEQCTQALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELFEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINCPEWKNYDFKKIAVRILSNDADTTHIVAIRKPLDETFDEEKIKAITDTGIQKILLNHLRQNDNDPKKAFTPEGIENMNANIVLLNGGKQHLPIYKVRISEKNNGGYFPIGQKGNRSQKYVTTAKDTNLFFAVYADQKGKRSFKTIDLRTAIECRKQGVSVAPSINEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1725 - protein, 1225 aa, Unknown
  Description of Unknown: uncultivated organism with predicted taxonomy: Bacteroidales
  MG22-71 effector
VGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQCIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCNRQLTDTRYIARFMMGVLSNIVRQNDNGVLESEAISKNLIVCNGKITDRVKQDWGLNDVWNHIVTPRFERLNQITNSSDFGEWCNKEGKRYFQTRIPLELQKRVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAVDESFDMKQIEKVYDPIVRNILTRHLKACNGDSKTAFSPQGVEEMNQHIAELNNENAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1726 - protein, 1521 aa, Unknown
  Description of Unknown: uncultivated organism with predicted taxonomy: Bacteroidales
  MG22-72 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVDYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKTIYEQCIKALYAQNEVRRNIIAPWSMKDLLTKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELRKEGQTIDEIHLEMGRDLKNTAEERSRIFRRNSENEDTNFRIKLLLEKFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSTNEKGDKLLFTLSPNDLVYMPSEGEEANGFSIDNYLNKEQIYKMVSATYKQCFFIPHTVADFIYKNKEFNVLNKIELTEDRRSIKEHCVPLKVNRLGK

SEQ ID NO: 1727 - protein, 1345 aa, Unknown
  Description of Unknown: uncultivated organism with predicted taxonomy: Prevotella sp. MGM2
  MG22-73 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYCKRAITKLLPLMRIGKFWHEESIDTTTKTRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLKNTAEERSKIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFAREAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLN

SEQ ID NO: 1728 - protein, 1283 aa, Unknown; identical to SEQ ID NO: 1672
  Description of Unknown: uncultivated organism with predicted taxonomy: Bacteroidales
  MG22-74 effector

SEQ ID NO: 1729 - protein, 1524 aa, Unknown
  Description of Unknown: uncultivated organism with predicted taxonomy: Bacteroidales
  MG22-75 effector
MTKNTRNIIGLDLGTNSIGWSWIQQLISPTPTQPSEYLFDETPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQPRKDITEKEKTKKIEYIKDIVRSVEDTGEKTKGKKAYKVTFDNGFKFISTEAEAPLWVGHTREVIVTTSLDATGAPKRDKEGDIIQSVKAPEEKDWTLKKIRTENHIDKSKLTVGEYILQTLLEKPDTKIKGAHVSTIDRRFYIHEINAILKVQEKYHKELRDKSLYEQCTQALYTQNEVRRNIIAPWSMSDLLIKDILFYHRPLKSKKSQISECPFEFHNYTDKNGASHRQGIKCIPTSHPLFQEYRIWQFIANLRIYERERFDNGKHFINEDKTSDFLTTKKKEELFEWLTEKDSVSQKTLLGHIGLKVEHYHWNFPEEKTYSCGETRHLIQSRLKKANLLKSFCSLVPENQKKEFELKLWHILYSVSDYNELRKALETFARKTGFTREEQDLFVEFFSSCPPFKKIYGAYSKRAIARLLPLMRLGKYWHEEHIDSATMNRIEHLISGEECNGIDVRVRENIAKFGLNQSIEQYQGLPQWLACYVVYNRHSEASEVTKWESPEELDNYIKAFKQYSLRNPIVEQISLETLRVVHDLWAEIQKEGQTIDEIHLEMGRDLKNTAEERARISKRNSENEDTNFRIKLLLKEFYTNEEDMEGIRPYSPSQQELLRIYEEGVWQQEKEIPQDIKDIKKKLSSDKDINEITHSDVQRYRIWMDQEYCSPYTGNPIPLSRLFTPDYEIEHVIPRSRYFDDSYNNKVICEAAVNKDKNNRLGMEYIMEAGGKTIELGNGKNVQVLKEREYVELVNEVFKNNTRKRNILLADEIPEDFSHRQLNDTRYIARFMKGILSNIVREKNADGTLELEETSKNLIVCSGRITDRIKQDWGLNDVWNHIITPRFERLNQKTSSDNFGEYVCKEGKRYFQTRVPLNLQKGFNKKRIDHRHHAIDAIAIACVNRSIVNYLNNAAANQTEREDLRRAVCIPERNGQTKRQLRSPWRNFAKDAENALRQIVVSFKQNLRILTKATNSYECFDTTSGKKIRRHQVNEEHYAVRKPLHEDFVYGEVILSSIASVNFKKALQKANRILDKRLKDKIFELRKLYSYSNKQIEEHLTKVCINTPEWKDYDFKKINIRILSNDEGATHIVAIRKPLDESFDKVKINTITDTGIQKILLNHLSRYAEDPKKAFSLEGIEDMNANITSLNGGKQHLPIYKVRVSEKDNGGYYPIGQKGNRSKKYVTTAKDTNLFFAVYADSNGKRSFKTIDLRTAIECKKQGLSVAPSVNEKGEQLLFTLSPNDLVYMPSEEEEANGFAIDNNLNKEHIYKMVSTDSNRCFFIPHTVADFISRGEEYNRHNKIELTEDRRSIKEHCVPLKVNRLGKKTL

SEQ ID NO: 1730 - protein, 1132 aa, Unknown
  Description of Unknown: uncultivated organism with predicted taxonomy: Bacteroidales
  MG22-76 effector
MSDLLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGRLGLKVERYHWNFPEEKTYPCGETRHLIQSRLKKANLQKAFHSLISDEQKECFERGLWHILYSISDYNELCKALKTFARKTGFTLEEQSLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGSNTRKRNIMLADEITEDFSHRQLNDTRYIARFMKGILSNIVREKNAEGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLRVATKATNSYECFDTASGKKIRKHQSNHEHYAIRKPLHKDSVYGEIILPSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSTNEKGDKLLFTLSPNDLVYMPSEGEEANGFSIDNYLNKEQIYKMVSATYKQCFFIPHTVADFIYKNKEFNVLNKIELTEDRRSIKEHCVPLKVNRLGK

SEQ ID NO: 1731 - protein, 1521 aa, Unknown; identical to SEQ ID NO: 1692
  Description of Unknown: uncultivated organism with predicted taxonomy: Prevotella
  MG22-77 effector

SEQ ID NO: 1732 - protein, 1420 aa, Unknown; identical to SEQ ID NO: 1676
  Description of Unknown: uncultivated organism with predicted taxonomy: Bacteroidales
  MG22-78 effector

SEQ ID NO: 1733 - protein, 1521 aa, Unknown
  Description of Unknown: uncultivated organism with predicted taxonomy: Bacteroidales
  MG22-79 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMSDMLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETKHLIQSRLKKANLQKAFHSLISDEQKDCFERGLWHILYSVSDYNELCKALKTFARKTEFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIRKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNTDGTLEPEETSKNLIVCSGRITDRVKQDWGLNDIWNHIITPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDTENALRQIVVSFKQNLRITTKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAQDTNLFFAVYVDSKGKRSYKTIDLRTAIECKKQGLSVAPSVNEKGDKLLFTLSPNDLVYMPSEEEEANGFSIKGNLIKEHIYKMVSANNRQCFFIPHSVADFISKGEEYNAHNKIELAEDGRSIKVHCVPLKVNRLGK

SEQ ID NO: 1734 - protein, 1558 aa, Unknown
  Description of Unknown: uncultivated organism with predicted taxonomy: Bacteroidales
  MG22-80 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKKPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDSVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKEQIYKMVSANDNRCFFIPHTVADFISNGEEYNRHNKIELTEDRRSIKEHCVPLKVNRLGK

SEQ ID NO: 1735 - protein, 1533 aa, Unknown
  Description of Unknown: uncultivated organism with predicted taxonomy: Bacteroidales
  MG22-81 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCNRQLTDTRYIARFMMGVLSNIVRQNDNGVLESEAISKNLIVCNGKITDRVKQDWGLNDVWNHIVTPRFERLNQITNSSDFGEWCNKEGKRYFQTRIPLELQKRVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAVDESFDMKQIEKVYDPIVRNILTRHLKACNGDSKTAFSPQGVEEMNQHIAELNNENAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1736 - protein, 1521 aa, Unknown; identical to SEQ ID NO: 1719
  Description of Unknown: uncultivated organism with predicted taxonomy: Prevotella
  MG22-82 effector

SEQ ID NO: 1737 - protein, 1521 aa, Unknown
  Description of Unknown: uncultivated organism with predicted taxonomy: Prevotella
  MG22-83 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKNGATHRQGIKCIPTSHPLFQEYRIWQFIANLRIYERERFDNGKHLINEDKTSDFLTTKKKEELFEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRAFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILPSIASVNLKKALMKADRILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNSGKQHLPIYKVRVSEKDNGGYFPIGQKGNRPKKYVTTAKDTNLFFAVYADSKGKRSYKTIDLRTAIECRKQGLSVAPSVNQKGDKLLFTLSPNDLVYMPSEEEEVNGFAIDNNLNKDQIYKMVSANNKQCFFIPHTVADFISRGEEYNSHNKIELTEDRRSIKEHCVPLKVNRLGK

SEQ ID NO: 1738 - protein, 1558 aa, Unknown
  Description of Unknown: uncultivated organism with predicted taxonomy: Bacteroidales
  MG22-84 effector
LYSSHHVATNSTYPFKTGHNRTPLNRFTTHKTQPYNIMTKNTRNIIGLDLGTNSIGWSWIQQLISPTSTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDKTSDFLTTKKKEKLYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEDFSHRQLNDTRYIARFMKGILSNIVREKNADGTLEQEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWHCFARDTENALRQIVVSFKQNLRVATKATNSYECFDTASGKKIRKHQSNHEHYAIRKPLHKDSVYGEVILPSIASVNLKKALLKAERILDKRLKEKIFELRKLYNYSNKQIEEHLTKVCINCPEWKNYDFKKIAVRILSNDADATHIVAIRKPLDESFDKVKINTITDTGIQKILLNHLSRYADDPKKAFSPEGIEDMNANIASLNGGKQHLPIYKVRVSEKNNGGYFPIGQKGNRHKKYVTTAQDTNLFFAIYADSKGKRSYKTIDLRTAIECRKQGLSVAPSINEKGDKLLFTLSPNDLVYMPSEGEETNGFAIDNNLNKEQIYKMVSATNNRCFFIPHTVADFISRGQEYNSVNKIELTEDGRSIKEHCVPLKVNRLGK

SEQ ID NO: 1739 - protein, 1521 aa, Unknown
  Description of Unknown: uncultivated organism with predicted taxonomy: Prevotella
  MG22-85 effector
MTKNTRNIIGLDLGTNSIGWSWIQQLISPTPTQPSEYFFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHIINEDKTSDFLTTKKKEELFEWLAEKDSVSQKTLLGHLGLKVERYHWNFPEEKTYPCGETRHLIQSRLKKANLQKAFHSLISDEQKDCFERSLWHILYSVSDYNELCKALKTFARKTGFTLEEQSLFVEAFSSCPPFKKDYGAYSKRAITKLLPLMRIGKFWHEESIDSTTKNRIEHLISGDECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITQRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRIATKATNSYECFDTASGKKIRKHQSNREHYAIRKPLHKDSVYGEVILPSIASVNLKKALLKAERILDKRLKDKIFELRKLYNYSNKQIEEHLTKVCINCPEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1740 - protein, 985 aa, Unknown
  Description of Unknown: uncultivated organism with predicted taxonomy: Bacteroidales
  MG22-86 effector
MKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEETNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAINKDKNNRLGMEYIMAAGGKTIELGNGKDVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKDNGGYFPIGQKGNRSKKYVTTAKDTNLFFAVYANSNGKRCFKTIDLRTAIECRKQGLSVAPSINEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1741 - protein, 935 aa, Unknown
  Description of Unknown: uncultivated organism with predicted taxonomy: Prevotella sp. MGM2
  MG22-87 effector
YQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELREKSLYEQCIKALYAQNEVRRNIIAPWSMSDLLIKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSQRQLNDTRYIARFMKGILSNIVREKNADGTLEPEETSKNLIVCSGRITDRVKQDWGLNDIWNHIVTPRFERLNTKTSSNDFGEYVCKEGKQYFQTRVPLNLQKGFNKKRIDHRHHAMDAIAIACVNRSIVNYLNNAAANQIEREALRRAVCIPERNGQTKR

SEQ ID NO: 1742 - protein, 1521 aa, Unknown
  Description of Unknown: uncultivated organism with predicted taxonomy: Prevotella sp. MGM2
  MG22-88 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLISDEQKECFERGLWHILYSISDYNELCKALKTFARKTGFKLEEQLLFVEAFSSCPPFKKDYGAYSKRAITKLLPLMRIEKFWHEESIDSTTKNRIEHLISGEECSGIDVRVREKVAEAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQLNDTRYIARFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKADRILDKRLKDKIFELRKLYNYSNKQIEEHLTKVCINCLEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVSPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1743 - protein, 884 aa, Unknown
  Description of Unknown: uncultivated organism with predicted taxonomy: Prevotella sp. MGM2
  MG22-89 effector
LLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTIFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAIRILSNDADATHIVAIRKPLDESFDKVKINTITDTGIQKILLNHLSRYADDPKKAFSPEGIEDMNANIASLNGGKQHLPIYKVRASEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNVDNSAKIR

SEQ ID NO: 1744 - protein, 1558 aa, Unknown
  Description of Unknown: uncultivated organism with predicted taxonomy: Bacteroidales
  MG22-90 effector
LYSSHHVAANSTYPFKTGHNRTPLNRFTTHKTQPYNIMTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEDLYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNTDGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLRIATKATNSYECFDTASGKKIRKHQSNHEHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKNNGGYFPIGQKGNRPKKYVTTAQDTNLFFAVYADQKGKRSFKTIDLRTAIECRKQGLSVAPSINEKGDKLLFTLSPNDLVYMPSEEEEANGFSIKGNLIKEHIYKMVSANNRQCFFIPHSVADFISKGEEYNAHNKIELAEDGRSIKVHCVPLKVNRLGK

SEQ ID NO: 1745 - protein, 1521 aa, Unknown
  Description of Unknown: uncultivated organism with predicted taxonomy: Prevotella
  MG22-91 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMAFIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEALLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLISDEQKECFERGLWHILYSISDYNELCKALKTFARKTGFKLEEQLLFVEAFSSCPPFKKDYGAYSKRAITKLLPLMRIGKFWHEESIDSTTKNRIEHLISGEECSGIDVRVREKVAEAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQLNDTRYIVRFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKADRILDKRLKDKIFELRKLYNYSNKQIEEHLTKVCINCLEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1746 - protein, 1558 aa, Unknown; identical to SEQ ID NO: 1667
  Description of Unknown: uncultivated organism with predicted taxonomy: Bacteroidales
  MG22-92 effector

SEQ ID NO: 1747 - protein, 750 aa, Unknown
  Description of Unknown: uncultivated organism with predicted taxonomy: Bacteroides
  MG22-93 effector
LGPNSIGWAVVEREEKSSDNSSLFTGGKILMAGSRIIPMSADILNNYEKGVSVSQTSERTKYRQVRRQYERFHQRRERLNRVLQELGFLPAHYSEQLDRYGKLPKGKEPKIAWRPTADGKYEFIFRSSFLEMMAEIRKSHPECKQIPYDWTLYYLRKKALYEKLTPEELSWVLHSFNQKRGYNAVRGQVEEDTETPDKLQEYRKSCLIGLEDTGEKTRGTNVYKLSFEDGTVFEMPLRKINFAVGDEVEFFITTRLDEDGTPKLNKQGLPVISYKIPNADDAWTLNKLRAEFTIDQSCSTVGQYIYDAILRNPQQKIRGELVRTVDRRFYRDELNRILDKQISLHPILQDDNKLQECLLALYPSNEAHRCTMSGRGFKALFMDDVILYQRPLKSKKSLIDACKYEFHTYINKDGKHEKSVLRCASRSNPLFQEFRLWQFIENLRIYKRKDLSDGHLLTDVDVTGKYLSDEDVRVALFDWMRDRSDVDQKSLLKYFKLSESDFRWNYVEDRKYPASETRAEMLKRLKKAGVPTDFLNLENEMALWEIFYSINEKKELEKALSSFARKHNFEVEKFIQSFRTIKPYPSDYCAYSTKALRRLLPLMRQGKYWKEEEIDDQTRSRIQRLIDGEWDEGIAEKVREKTVSLRCESDFRGLPVWLASYVVYNRHSEASEIKKWESPEEMDADIRKFRQHSLRNPIVEQVCLETLRVVRDIWKEEGISMKSTWRWDVKCGLQQRNAKRVAAYKWKTSR

SEQ ID NO: 1748 - protein, 1496 aa, Unknown
  Description of Unknown: uncultivated organism with predicted taxonomy: Prevotella
  MG22-94 effector
MKNILGLDLGPNSIGWAVVQTEKEGAEESLFAQGKILMAGSRIIPMDASTLGDFEKGNSTSQTADRTKFRQVRRQYERFHQRRERLNRVLLTLDYLPEHYAKELDRYGKLPKEGEPKLAWRPTPDGAYEFLFRDAFLEMVSEFKKHHPELKQIPYDWTIYYLRKKALRQALTPHELSWVLHSFNQKRGYNAVRGKEDKETESPDKRQEYHKSVLTSISDTGEKLRGNVVYRLAFSDGATFDVAGRHISLSEGEEVEYIKTTKLDEDGMPKLTRQGVPDVSYKIPNADDAWTLNKLRAEFTIEQSGTTVGEYIYDAILRNPGQKIRGELVRTIDRRFYRDELCRILDTQIPLHPVLQDGNKLEECLQTLYPNNEAHRLSMLGRGFKGLFMDDVILYQRPLKSKKSLIDDCKYESRTYVNQDGARVRVGLKCASRSHPLFQEYRLWQFMENLRILKRKEFVDGHLRTNVDVTGHHLPDENSRVALFDWLYGRATVDQKALLKYLHLSEEEYSWNYVEERDYPAAETRAEMQKRLKKAGISADFLTPEREMALWEILYSVGVQGELEKALRRFASKHGVDADKFCQSFRTIKPYPADYCAYSTKALRRLLPLMRQGRYWSLSAIDPQTRQRMQRLIDGEWDEGISDRVREKTSDLRHETDFRGLTSWMATYVVYNRHSEAADIKKWHTPEEMDADIRRFRQHSLRNPIVEQVCLEALRTVRDIWKEIGKIDEIHVEMGRNMRATAKERQKTSQLQLENEQANLRIKALLQEFMNPEFEVEDVRPYSPSQQELLRIYEGTVLEQEAGHIDEPIREIIRKFSQTDAAKRPTTSEVLRYKLWLEQKYRSPYTGEVIPLGKLFTPAYQIEHVIPQSLYYDNSFNNKVICEAEVNLLKGNQLGMPFIMRHANEKVVCSMGKQVKIFTPEAYRLFVEEHYRGRKMTILLSEEIPTAFNDRQKNDTRYISRYIIGELSKLVREEKPDGTLEQEPTSKNVVVLNGSVTDKLKKDWGLVDVWNEIITPRFRRLNEMEGSQRFGQDAEKGGKRYFQITMPLELQRGFQRKRIDHRHHAMDAITIACATRQVINYLNNDHSHAGQGREDLHRAVCRKRGSEWFIRKPWDTFTQDAHARLNQIVISFKQNLRVINKTGNHYWRYNPKTGKKEIFHQQKGDSWAIRQALHKESVFGRVNLRTTKFVSFKEAFASLERIVDKRLKRAILAGMARYSGHCTDKQMLIYLQEQQEWKSFDFKKVAVYTFSEDDDKSRMCAIRKRLDDSFDKKKILSVTDTGIQRILLRHLEQSGGNPKDAFSPEGIVRMNETIQELNGGKPHQPILSVRITETMGNKFAVGMRGNRGKKFVEAAKGTNLFFATYLQEDGKRLFRSLPLNEVVERQKQGLPVAPERDEQGNSLLFVLSPGDLVYLPTSDEQEGRVEPAALDLSRIYKMVSCTRSQCLFVPHRVASVIKDKYEYSSMNKMERAITGEMIKESCLPLEVDRLGRYRIK

SEQ ID NO: 1749 - protein, 1381 aa, Unknown
  Description of Unknown: uncultivated organism with predicted taxonomy: Bacteroidales
  MG22-95 effector
EADADEEKKKKEVKTLEKATVVSIEQSDAAKGGRYWWNYHLSNGMIYKRTSERPMEWLGTERYFIVTTKLDADGNPKKRKDGTTDKSISAPSADDWGLMKLKTESEIGESGKQLGEFIYDKILADPTAKIIGGEVTVVDRRFYRDELRAILDKQREYIAALRDRELYAECIEALYPSNAAYRNIIAGKDFSYLLTDDVILYQRPLKSKKYLISDCPYETVTFTDKSGQEVTKRLKCVPRSHPLFQEFRVWQFIANLRIYQKERVEGGRKLIDADVTDLLLKNDADRVALFEWLNARADVVQDDLLKFLVAEARKRPISEQSADFGELLVMAHGAKAKKDKAYTAFKWNYVEDKKYPCNKTHSVILSKLSSEEEREALTPEIEEMIWHALYSITDKREFDKAFSPNARHPERGLYATLSRHFSPESIGGIKSIILKESDYGSYSRRALSRLLPLMRCGALWSAEAIDTATRARIDKIIDGEWDEGIDTRTRNLMAGMSTVEQFRGMATWQACYVVYGRHSEASEVMRWNSPDDLRAFITSFPHNSLRNPTVERIILETLRIVEEIWRHYGHIDEIHVELARSVKQNKEQRERAMTQMAENERRNLRLRAMLEAFLNDRDPIGFDPDANINPGSPNQQLKLRLFEDTAFSYAQANGDDQVEEMLNIRNSITGGSDEKSATPAQIRRYALWLEQNFRSPYTGATISLARLFTDDYQVDHIIPQALYWDDSFNNKVLCEGGVNNTKSNALAFDFIAAHQGETIALPNGRKVTILSMEQYQELVLATYKNNRAKCEKLLMKEIPAEFTQRQLNDTRYISKVVKSLLSNVVRERDEEGNLEAEAISKNVIVPVGAMTDRLKQDWGLKDVWNQLMLPRFRALNDKMAPYRFTKITRRGHEIPAMPLELVKGFSKKRIDHRHHAMDAIAIACTTRRHIQYINGDAGEAEADKSKYIDKQRVIDARRTIRNKIAHRLDGDGKPIFDKPWTTFTEDVKRALENLIVSFKQTNKVISHTSNKSQRYVDGQKRFVRQTKGEQIAIRKPLHKETVSALVNLREVKEVTLKEAVATVPTIVDKELRAKIVELIAKGYDEKRMKAYFEEHNDEWTDVNPARKKVKVYRFSEESGSNHYYATRVALDTTFDAKKIRTITDTGIQKILLRYLEAKGSAAVAFTPEGIDELNANIARYNGGRQHQPIVKVRTYVNGDRYAIGTVGNKSKKYVVAQSGTLLYYFAFAHTEYDKKRKEEVTLRVFSAIPLRDVIAAMKADRDNWEDCVTASLKERGIIPADARFLFKLSPGDMIYLPDAHETIAPSAIDRAKVYKVVSFFGDNGGYLFVVPYSVAKPIIDKIEYGTQNKVNLAGELKQRIIPLAVDRLGNITWVYDPAGEK

SEQ ID NO: 1750 - protein, 890 aa, Unknown
  Description of Unknown: uncultivated organism with predicted taxonomy: Bacteroidales
  MG22-96 effector
MRVGKYWTADNIDPTTLHRIQLLISGEDDGELNLRTRDKLENLRNIEDFQGLPVWMACYVVYGRHSESGNIQKWSNPHDIDIFLNNFKQHSLHNPIVEQVVLETMRVVRDVWAKFGNLDEIHLELGRNLNQTAEQRKRDTERNLGNERANLRAKILLTEFLNPEMNVENVRPYSPSQLELLRIFEEGILDDSAGNMPDDIQEIIKKLDSTDIKRRPTESEVLRYRNWLEQGYRSPYTNEIIPLSKLFTTAYQIEHIIPQSLYFNNSYNNKVICEAEVNQLKSNQLGMEFVKNHGGEIVECAFGRKVRILTPEEYTAFVEQHYKHNVHKKNNLLSTELPSEFSSRQLNDSRYISKLMIGLLSNIVREETDGHLEEEAISKNLIVCTGKVTERLKQDWGLKDVWNEIIRPRFERLNQMEQTERFGHWENKQGKNVFQITIPIELSSSVDRKRIDHRHHAMDAITIACATRNMVNYLSNQASGKTRFDLQHALCIKQKMDAQGNYKWLIRKPWQTFTEDAKTALNEIVVSFKQNLRVINKTSNHYETIGSDGKKILRRQSKGDSWAIRKSMHKDTVFGNVNLRSIKQVTLKQALQQVDRICSKELKKYILSLQKLHFSGKGIEAQLKEKGRRLFPDIDLKKIDIYYFSNDSENTRMVASRKPLDNSFNQKAIEAITDSGIRKILLNHLEQCNGDSEAAFSPMGIEQMNEHITSLNNGIPHKPIYKVRKSEIQGSKFPVGTKGCRSKKFFEADKGTNLFFAIYVDSEGKRSFDSIPLNIVIERQKQGLPSCPEKDSNGNTLLFCISPSDTVYVPTPDEMETGNIDLNYIDKGRLYKMVSCSGRQCFFLPIEIACMIWDKVEFSATNKMERSITGEMIKDICIPIKCNRLGELLP

SEQ ID NO: 1751 - protein, 1490 aa, Unknown
  Description of Unknown: uncultivated organism with predicted taxonomy: Bacteroidetes
  MG22-97 effector
MKRVLGLDLGTNSIGWAVVEKDSLNETDGKIIMSGSRIIPMDAAMMSDFDKGNAQSQTAERTRLRSIRKLNERHKIRRQRLNRVLSILKYLPEHYANNIDRYGNIDENKEPKIAWKINSNGRKEFLFMDSFEEMVAEIHQKHPDAKTIPYDWTLYYLRSKALHKPISKFELAWVLHSFLQKRGYYQLRGEEEDSTAKKEEYASLKVISVEDSGDRKGNNTWWNVNLENGLTYKVCLQDRPPLEGKTRDFIITTKLDKEGKPALDKDGKPRYSIRAPKDDDWGLMKIRTESQIAKAGMTVGQYIYNTILNTLDKKIRGQIVRTIERKYYREELLRILECQIMFHLELQDKELYTECIEALYPSNDSYRASIATRNFKYLIADDVIFYQRPLKSKKSEISDCPYETRTFVDKSTGEIKKTSLKCISRQNPLFQEFRLWQFISNLRIYKRYDAEDGRIVINKDITKDLLPDANVVASLYEWLSTKAGVSQEQLLKYLKLSSADYRWNYVEEKKYPAGETRAMLMSGFKKAGIDTNLLTEEIEMALWHILYSVNDRQELIKALSSFAVQHQWPAEVFSNVFCKTKPFEDYGAYSEKAIKKLLPLMRVGKYWTADDIDPATRHRIQLLITGEDDSELNLRTRDKLEDLKSIDDFQGLPVWMACYVVYGRHSESGNILKWSNPHDIDIFLNNFKQHSLHNPIVEQVVLETMRVVRDVWAKFGNLDEIHLELGRNLNQTAEQRKRDTERNLGNERANLRAKILLTEFLNPEMNVENVRPYSPSQQELLRIFEEGIIDDSTGNMPDDIQEIIKKLDSSDIKRRPTESEILRYRNWLEQGYRSPYTNEIIPLSKLFTPAYQIEHIIPQSLYFNNSYNNKVICETEVNQLKSNQLGMEFVKNHGGEIVECAFGRKVRILTPEEYTAFVEQHYKHNIHKKNNLLSTELPSEFSSRQLNDSRYISKLMIGLLSNIVREDADGQLEEEAISKNLIVCTGKVTERLKQDWGLKDVWNEIIRPRFERLNHMEQSERFGHWENKQGKNVFQITIPLELSSSVDRKRIDHRHHAMDAITIACATRNMVNYLSNQASGKARYDLQHVLCVKQKMDAQGNYKWLIRKPWQTFTEDAKAAIKEIVVSFKQNLRVINKTSNHYEAIGSDGKKILRRQTKGDSWAIRKSMHKDTVFGNVNLRSVKQVTLKQALQQVDRICSKELKKYILSLQKLHFSDKGIEAQLKEKGRQLFPNIDLKKIDIYYFSNDSENTRMVATRKPLDASFNQKAIEAITDSGIRKILLNHLEQYNGDSEAAFSPMGIEQMNEHITSLNNGIPHKPIYKVRKSEIQGSKFPVGTKGCRSKKFFEADKGTNLFFAIYVDSEGKRSFDSIPLNIVIERQKQGLPSCPEKDSNGNTLLFCISPGDTVYVPTPDEMETGNIDLNYIDKGRLYKMVSCTGKESHFLPLSSATTIKDKYEYSSLNKLGRALSGEMIKDICIPIKCNRLGELLP

SEQ ID NO: 1752 - protein, 979 aa, Unknown
  Description of Unknown: uncultivated organism with predicted taxonomy: Bacteroidales
  MG22-98 effector
MTRKILGLDLGPNSIGWAVIARETSSDEENSGRIIDAGSRIIPMIDDSKFEKGETISATKDRRQKRSMRRMLERKKQRRQRLLRALNVMGFLPEHFAAYIDKHGNMRHDCDTPLMAWEQNADGHRQFIFTDAFEEMVADFRQHAICSCADGKLIPYDWTPYYLRKKALTTAISREELAFVLTQFNKKRGYHQLRGDELDEAEQKSKNQEIRTLTVKEIIDYKKISQKHKYTFLLSNGMAFERESTSKLDDWVGKERDFIITTEYDEEGNIKKNRFGEDKISIRAPEETDWTLRKKKAENDISDKKEVGEYIYDELLRTPDMKIIGGKVMTIDRKFYRRELRKILATQEPYHPELKDESVKRKVAKALYPNNTDHRRAIMRKSLSDIIVDDIIFYQRSLKSKKSTIADCPYEKRYYKDSEGMLKKTGVKCISKSHPLFQEFRTWQFINDLCITRQGEPVDFSNEEAADLFDYLHCKEKTNETDILKNFLKLNKQEQELHKWNYGKDAEKPCCPTHCQFVERFKKIGLEPSILTAETEQVLWEIAYSVKDVAEYNKAIEKFADRIGADREEFTKAFRNLPDYKSEYGSYSHKAICKLLPLMRRGSAWQWEAIDKDTREKIGHIINGEHDERLTEDTRQNFSKKTKEDDFQGLQPWEACQLVYGGQTDDEEIQKWDSPEDVDKYIASFRQHSMRNPVVEQVVLETLRTARDIMRRYGKVDEIHLEMARSMKQTSQQRKADNERMQSNYKRNQEVRDKIAEELQQNATNGERPKIGAKKIASYKIWEDQKGRSPYTGKAISDAALLNADGRYDIDHVIPQSRYYDDSLNNKVICEKEVNLKKGNMLGLEFIQKHGGETIQLSSGGEVTILREEEDKKLVNETFKGRKQKIMLMTETPNDFTNRQKTDTQYIASTMMRLLSNIVREQDPDGSLEREVRSKNPIVCTGGITDKLKKDWGVNDAWNRIILPRFKRMDELTMAERTG

SEQ ID NO: 1753 - protein, 1537 aa, Unknown
  Description of Unknown: uncultivated organism with predicted taxonomy: Flavobacteriales
  MG22-99 effector
MAKYILGLDLGPNSIGWAVVEGVEQEEHVGLVPQRIVMSGSRIIPIDKTTLSNFETGNTVSQTADRTQKRGMRRNLERKKLRRQRLFRVLKTMGMLPRHFAEHVDGLGNLDEDGRRLSMAWAPQEGERPLFLFQDAFAEMVGEFAARQPQLMLGGKLVPKDWTLYYLRKKGLTDRLEKEELAWVLASFLQKRGYRYMRGQDADNTKENEKKELRTLEIVDLISDGDGSKKGKGVDLVLEDELRFTVKNANEADFKRGQTLDFIVTTTYDERGKVKMDANNKPMRKLSMPKEGDWELLKTRTEQRIRVQEGSTVGSYIYESILENPDVKIIGERVHVVGREFYEEETKRILEAQTQFHPELSDPEMRDKVAHALYPNNEAHRNAILNRSLADIIVADVVFYQRPLRSKKSSISDCPFEKRNYVGSDGEERKVGVKCISKSHPLFQEFRTWQFVGNVKLVSKDDSGDDKNLSLLGRKKCFNGGTCEEGAELFEWLHNRKSVKQGDFLKGFVGLTKGEIDRYYRWNYEADKEIPCCETRAEFLGYFKKAGLPADALTEEAERRLWEVAYSVSDREEFRKALRSYARWIGADEERFVEACGKMKPFPSDYGSYSEKAIKKLLPLMRTGKYWSFDAIAPETQSKIRHLITGEEDERLTDEVREHFKYRVDEANYQGLQLWEACELVYGSSFSKDDIAHWKSPDDLDRWLEGFRQHSLRNPIVEQVVLEAVRTVRDIWRKIGHIDEIHLEMARDMRKTAQERKRDSERNSQNFKARQRIKMLLDEFEKMRIDDVHPYSPMHQEKLRIVEDGVFDRVSAKGDEKSKEMLKDMRAFQTNVEKNNVTPGDISRYMLYLEQNYRSPYTNETISMKRLFSSDYEIEHVIPRSRFFDDSMSNKVICEAKVNKEKGNMTGMEFIMKRGGEKIELGEGREVTIVNEKDYRQYVDEVYKNNSRKRKNLLSEDIPGGFSNSQMNNTRYISRLVMTILSNIVRDDREDGKSDEGIRANRLITCQGGVTDKLKKDWHVNDVWNRIILPRYERMQNEVMKGVTFVTNNSRGHEIPTMPDKLKTEEYNPKRIDHRHHAMDAIVIACATRSIVNFLNNESARDEASEGSEKAKARQTYAELRSLLCVKDADNDEKVIRKPWENFEVDVLKALEDIVVSTKHKQRVLTRTSNHYEKFVDGKKQKVSQKGKSYAVRLSLHKDTVWGQVNLRRQEGVSLLTALKDPQRVVDKALRKKIVELQAQGKKPKDIKKYFAENADVWPETQGKVAVWHFTDDEPTKTYATRFISSLTELFDKISTREKAEEKIQSITDTGIQKILLAHLAECNYDVAEAFSPIGIERMNANIVALNGGKQHKPIKKVRRTESGSKFAVGASSGSRHKFVENAKGGNLFFAVYLAVSEDKNGNEVRKRQYETLPLRTVLDRLKQGLSPVPEVDEGGNRLLFSLCPYDLVYVPKEGENVGELTAERLDKERIYMFVSSSDSDAMFRPHRVAAPIVEKKEFTLHNKMSKAVTGEMIKEVCIPLEVDRLGDITKKRIGDD

SEQ ID NO: 1754 - protein, 1489 aa, Unknown
  Description of Unknown: uncultivated organism with predicted taxonomy: Bacteroidales
  MG22-100 effector
LGPNSIGWAVVQTELDDEKKDTLYSSGKILMSGSRIIPMSADIMNNFQKGVSVSQTAERTRYRLVRRQYERFHLRRERLNRVLMTMGYLPEHYAEQLDRYGKLPKGKEPKLAWRMAKDGKPEFIFREAFLEMVDEMRAVHPDLQQIPYDWTIYYLRKKALSRALRPEELAWVLHSFNQKRGFFAVRGQVDTDAEAPDKLQEYHKARLASVVDTGEKNRGNAVYRLCFDDGVEFEVALRRMTLQVGDDVEYIKTTKLDDDGMPKQTKQGKPDISYKIPGANDAWTLNKLRAEYTIDQSQSTVGEYIYKALLTNPQQKIRGELVRTIDRHFYRDELRRILQAQKPHHPLLQDQEMLDECLQMLYPHNESHSNSMRGRDLCALLTDDIIMYQRPLKSKKSLIAGCKYETHRYVDKDGKMKTEGVKCASKSHPLFQEFRLWQFIENLRIIQRKDTSNGRVRYDVDVTEQFIHDYEGRAALFEWLQTRSKIKQDALLKHFGMKEEGFRWNYVEDREYPAGETRAEMLKRLKKAGVDADFLTAERELALWEILYSVNGQEELGKALRTFARKHQLDEEKFAQNFCTIKPYPSDYCAFSVKALKRLLPLMRCGKYWTAEQIDASTAQRIQKLIDGEYDEQITEQVRNATATLRSVGDYQGLSTWLASYVVYGRHSEASDTKKWETPEDMEADIKAFRQHSLRNPIVEQVCLETLRTVHDIWKEVGHIDEIHVEMGREMRATAKEREERSARQLRNEQTNLRIKALLQEFMNPALEIEDVRPYSPSQQELLHIYEETVLEQEAGNIDDDIREIIRKFTQTEASKRPTEGEVRRYKLWLEQRYRSPYTGKNIPLGKLFTPAYQIEHVIPQSVYYDNSYNNKVICEAEVNLLKGNMLGMAFIKEHAGEIVPLSLGGEVEILKPDTYREFVEEHYKGRKRQIMLSEEIPTEFTSRQMNDTRYIARFIMGELSKLVRQQNADGTYEEEATSKNVIVLNGAITDKLKKDWGLVDVWNGIIAERFKRLNQMEGGTRFGHEENKDGKRYFQIEMPLELQRGFNRKRIDHRHHAMDAIVIACATRAVVNYLNNDHAHDGAGREDVKRAVSRKRDQTWLINKPWPTFTEEAKEELKQMVVSFKQNLRVINKTSNHYEKYNTATGKKEKFRQHHGDNWAIRKALHKESVFAQVNLRSIQTVNFKTAYEQVLRIVDKRLKRAIRDAKNRYAMRCTDKQILKYLQGMPEWKDYDFKRIAIYAFSNDQEKTQMCAIRKRLDDSFDKKKIASVTDTGIQQILLHHLEENGNNPKEAFSPEGIERMNANIAALNNGKAHQPIYVVRISEPMGQKFAVGHIGNRSKKFVEAAKGTNLFFAIYDLGGDRRGYTSLPFREVVERQKLGYPTAPETDEEGHRLLFVLRPGDLVYVPTEEQLQSRIDARAIDKSRIYKMVSCTGNECHFIPANTASFIRDKYEYGSLNKLARAITGEMIKEICIPLEIDRLGRYRIK

SEQ ID NO: 1755 - protein, 1215 aa, Unknown
  Description of Unknown: uncultivated organism with predicted taxonomy: Bacteroidales
  MG22-101 effector
RIPNADDAWTLNKLRAEFTIDQSHSTVGQYIFNAILRNPQQKIRGELVRTVDRRFYRDELRRILEVQIPLHPALQDREKLEECLLALYPNNEAHRRSMQGRDFKALLMDDIILYQRPLKSKKSLIGECKYETHTYINKEGKRETIGLKCASRSNPLFQEYRLWQFLENLRILKRKTLDGNHYRTDVDVTTLFLRTDESYTSLFDYLRSRAEIDQKTLLKFFKLKEEDYRWNYVEERKYPTSETRAEMLKRLKKAGVPTEFLTHELEMALWEILYSVSGQSELEKALRKFAEKNNLDQETFYQCFRTIKPYSADYCAFSTKALRRLLPLMRRGHYWNYNAIDPLTQQRIARLINGEEDTTISNRVREKAETLRTETDYQGLPTWLASYVVYGRHSEASEIKKWASPEEMDRDIRCFRQHSLRNPIVEQVCLEALRTVRDIWKEIGSINEIHVELGREMRATAKERESRHNRQLENEQTNLRIKALLQEFMNPEFGIEDVRPYSPNQQELLRIYEDTVLSQEAGRVDEPIREIIRKFSQTDAAKRPTTAEVLRYKLWLEQKYRSPYTGEPISLSKIFTSAYQIEHVIPQSVYYDNSYSNKVICEAEVNLLKGNMLGMPFIMQHAGEKVQCSVGNIVTISTPEAYRAFVEEHYKGKKQKILLSEEIPTNFTARQMNDTRYISRFIIGELSKLVREHNPDGTLEQEAVSKNILILNGAVTDKLKKDWGLVDVWNGIIAPRFRRLNAMEGSQRFGHEAMKDGKRYFQIEMPLELQRGFQRKRIDHRHHAMDAIAIACATRNVVNYLNNDHSHEGAGREDIKRAVSSKRSGQWLVNKPWSTFTQEARKQLQQIVVSFKQNLRVINKTSNRYVRYNPQTRKKETIVQQKGDNWAIRKPLHKESVFGRVNLRTQKAVNFKTAYANIERIVDKRFKHAVLAAIKRYGGKCTDKQVLKYMQGMPEWKDFDFKKVQIYVFSNDDVKTQTSAIRKRLDDSFDKKKILTITDTGIQRILLRHLEQNGNNPKEAFSPEGIVRLNESMLELNGGKPHLPIFAVRISEPLGNKFSVGMRGNRSKKFVEAAKGTNLFFAIYQQEDGRRLYRSVPLNEVIERQKQGLSSAPEHDENGNALLFVLSPGDLVYLPTKEERNSRIDVQAIDKTRIYKMVSCSGNQCQFIPINVASAIVDKYEFSSANKMERAITGEMIKELCLPIEVDRLGRYRLK

SEQ ID NO: 1756 - protein, 1377 aa, Unknown
  Description of Unknown: uncultivated organism with predicted taxonomy: Clostridia
  MG23-1 effector
MGKKMYVGLDMGTSSVGLAVTDENYKLYRVKGKDYWCSRTFDEADTAVERRTNRISRRRRQREVARLGILRELFADEIAKVDPGFYARLDESKYHLEDRDNKQPYAIFADKGYTDKEYYARYPTIFHLRSELIDSDKPHDVRLVYLALANMFKHRGHFLNDSLSSDKPLADTTEAYSNFYYTASELSISFPAEAQPDSIDAASLEALLGDKGVSRTDKAKNICQYLAIDKKTSKPLYTLINLICGLNIKLIDIYGAELIDEENKKLSIGFRDSSYEQQDADGRKLLGENYAIIDAAKELHDIGLLSSIMKGYKYLSQARVALYEEHAADLKKLKSVLKRYDKDSYRKVFRSMDEGSYSAYIGSVNSGTKIRRGVKDGSADTFCKSMKKVLEKLPKDDMDVQYLLAKATDSSLLPKQLTFENGVIPNQLHAAEMKAILRQAEKYLPFLLEKDEYDLTVSQRIIQLFTFRIPYYVGPIGKNHAGEKGYNIWATRRAGEEDGRVYPWNFEQKIDTKAAAEKFIERMVRHCTYINGERTLPKCSLLYEKYMVLNELNNLRINGEKPAVSVKQDIYTKLFCRGKRVTMKMLKDYLYNSSLIPSKEDVVISGIDNGFNTSLTSVGKFRGILGDAVFADSNQKMIEDIIFWGTVYGNDKKFLKERIEEVYGDRLNHDEIKRILGFNFNDWGNLSREFLELEGECECGRCSIIQAQWNTNHNLMELLSDQFTFKNELEKKTGSAEKALADWSIDDLEGKYLSAPVKRMIWQTIKMLREVCEVTGRTPDKVFVEMAREDGEKGARTVSRKKKLLDLYDAIKHEERELAKVFSDEIDSKTEADFRSKKLYLYYLQQGRCMYSGDIIHLSDLMNDNLYDIDHIYPRHFIKDDSLENNLVLVKKQINNRKQDTFPIERSIQEDMRPFWKSLADSGFISAEKYKRLTRRDAFTDEEKAAFISRQLVETRQGTKAIADILKQALPDTEIVYVKAGLVSDFRQKFELYKVRALNDTHHAKDAYLNIVVGNTYSTKFTNNPLNFIKAGAKRPQDNQFKYNMDKIFDYNVISRGERAWIAGSDGSICTVKKFMSRNTVLITRKAKEVHGALSNKATIWGKNVAKPGAYLPVKSTDLKAQDVTKYGGITSIANSGYTLAEYKVNGKTTRSLEALPVYLGRAEQLTEKTVVDYLSSSLQESSKKKIEDIQVRKLFIPQGSKVKIDGFCYYLGGKTGDSIYLNNAVPLYLSSTSEEYLRKLLKAVENNNYNERDKNGQIILTAPKNVQLLSSIFDKLRSKPFSNNKWNIYFSIVNGKETKVEQLFSKLSIDKQAEVISQIVIWINSSRQNVNLSLIGGSAHSGTQALSKTVSRLNECMLISQSITGIYEHSVDLLTI

SEQ ID NO: 1757 - protein, 1375 aa, Unknown
  Description of Unknown: uncultivated organism with predicted taxonomy: Firmicutes
  MG23-3 effector
MSEKIPYYIGLDMGTNSVGWAVTDENYKILRGKGKDMWGVRLFDEAQTAAERRTNRVSRRRRQREVARIGLVKEYFADALNAVDPGFMVRLEESKYWLEDRSEENQQKFALFNDKDFTDKEYYTVYPTIFHLRKELIESTEQHDVRLVYLAILNLFKRRGHFLNKSLESDGETMSMAEAYAALVDEAAALEITLPMPIDAKKLEEVLSQKGVSRKFVEQDTNEFFGFSKKASEARELVKLMCGLTGKMRNIYGEELIDDDNKKLALSFRSNDYEEKMNEVAELVGDENMRLLEAVKEVHDIALLANILSGEQYLSVARVKQYNKHKEDLQQLKRVLRTYDKAAYKKMFRVMGKDNYSAYVGSVNYKEHKERRNAGAGKDGESFRKAVEKVIDALPEEAQLDQDVIEIREKIKNEAFLPKQLTSANGIIPNQVHLRELKRILENASGYLPFLNEIDESGLTVKERIAQLYEFQIPYYVGPLSKQNSKNAWANRRPGEEKGRILPWNFEQKIDVNQAAEDFIKRMVRHCSYLDAEFTLPKQSLMYEKYMVLNELNNLRINGEKPTVLQKQQIYNELFGKGKRITQKALINYLKDEGIVEKDSEPIISGIDGDFKASLSTFGKLRTVLKEEARKDSSQEMMDQIVFWATVYGDDKRFIRARIEEHYSEILDDHAIKQLLGMKFNGWGNLSKAFLEMEGASKEDGVYRSVIQALWETNDNLMELLGQRYTYKEELEKRVQTKEKPLAEWTIDDLDGMYLSPSVKRMVWQTLKIIREITEVRGSAPSKIFVEMARDDAQTKAKNKGKRTKSRKDFLLECYKDDKAWKDELTSVDDGELRAKKLYLYYLQMGRCMYSGEAIDLASLMSGNTMYDIDHIHPRHFVKDDSLENNLVLVKKDKNAHKSDNYPLESEIRNKQFGFWKSLLDKGLITKTKFTRLIRSEDFSPEELAGFINRQLVETRQGTKAITKILQQAFPDDDMEVVFTKAGVAAKLRHDFDLVKVRCVNDTHHAHDAYLNIVAGNVYNAKFTSNPLRFIKNEVKKGNASYHMDKIFFRDVKRGNKLVWQAPNNEEKTPGTIAIVREQLARRTVLQTRRSYMAHGILSDATIYSKDTAKTESYRPVKSSDERLSDVKKYGGMTSIKNTAYALVEYTVKGKTIRSLEGVPIYLGNCSKDDKKLLQYLQEILQRENKNKQVENVSVRMYPIRQRSYLKVDGYYYYLGGATGSSVYLLDAMSVYLSKEDMGYVKKVEKAVAQQRYDECTKEGEFVLTREKNMDLYNKLVDKFSHGVFIKRKASILKTLEEGIDVFSELNIEKQCGIIMQIFAWITTSQQNVNLTDIGGVAHAGTLLISKKLSTSREALLIEQSLTGLWSKTTDLLTV

SEQ ID NO: 1758 - protein, 1371 aa, Unknown
  Description of Unknown: uncultivated organism with predicted taxonomy: Clostridiales
  MG23-4 effector
MEERKMYWGLDLGTNSVGWAVTDQNYQLMRAKGKDLWGARLFDRADTSAERRGYRVSRRRRQREVARCGVLKEYFYEEISKMDAGFFVRLEESKFWKEDRSEGNQQKYALFADANFTDKDYFEKYPTIFHLRKELLETSEAHDVRLVYLALLNMFKHRGHFLNTALSAEETETDMNAAYQELVDTAGYFDIAFDPQLDAREIENILGEKGISRSRILEKLSTYMGISKSDKAAYELLKLVCGNAGKLVNIYGSEILGEENKTLSISFRDSNYEEKETQVKELVGDDYFELLLAAKAVHDIGLLANILKGHAYLTYARVESYEEHKKDLQLLKCVLKKYNPEGYDKMFRVMEPGNYSAYIGSVNSKESGKVRRNEGKGRSREDLYKTIRKLLGQCPQDDQDVALILSKIESETFLPKQLTADNGVIPNQVYAKEMRKILKNAATYLPFLKEKDESQLTVAERIIQLFSFRIPYYIGPLGQEHLDEKGYNEWARRIAPGKVYPWNLEEKFDTKEAAEKFIERMVRHCSYLTQEKTLPKNSLLYEKFMVLNELNNLKIHGEKITVEQKQDLYNSLFIKGKRVSIAQIVRHCQLSGWVEKDDTDFLSGIDLTGFKASLSSVGKFRGVFGEGFFNDKQTAMAEQIIFWATVYGNDKSYLRERIEEEYLELLDEKQIKRILGFKFEGWGNLSREFLYLRGTSRQDSERSVIMALWETNDNLMELLSERYTYKEALQEQIKEKEKTLEEWTIEDLGGMYLSAPVKRMLWQTMKILLELKQTLGQTPDRVYVEMSREDGEKGERKDSRKKKLLDLYSALKGEEKAWRKEIEDRPEADFRIKKLYLYYRQMGKCMYTGETIELADLFNDNLYDIDHIYPRHFVKDDSIENNLILVKKQKNARKGDSYPIEREIQRARYQLWKMLADKNFISREKHQRLIRTTPFSEEEKAGFISRQLVETRQGTKAIIQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVHGGITRKDTIYNKETAKGQGYIAVKGSDPRLCDVTKYGGRTSINNMFYTLASYWVKGKSVLSLEAIPGYLGNAEHISDETLLRYLQDSLEKENPGKVISDLQIKYRCIRYKSLLKIDGFYYYIVGKTGKRIYLESAVPLILNNEDAIYLKKIEKAVSGQYFEEKREGQLIITEERNQKLYDILLEKLTDGIYRNKKASLQTILQEGREKFIRLSIPNQCQILMNLVEWFQLSCVTADMKEIGGSANSGKCLMGKKISDCSEMILITQSATGLQERRIDLLKL

SEQ ID NO: 1759 - protein, 1385 aa, Unknown
  Description of Unknown: uncultivated organism with predicted taxonomy: Firmicutes
  MG23-5 effector
MDKVKQAPYYIGLDMGTSSVGWAVTDEDYKILRGKGKDMWGVRLFDEAKTAAERRTFRVARRRRQREVARIGLLREYFADAIHEVDPGFFHRLEESKYYLEDRDDDNQQKFALFNDKNFTDKEYYAQYPTIFHLRKELIESSDPHDVRFVFLAILNLFKRRGHFLNKGLSADGGESSMAEAYETLVEEARNQEIILPEALDTQALEACLGEKGLSRSTIKENVMELLAVSKKDKAATELISMMCGLMGTLQKIYGSDLIDDEHKGMKISFRAMNYEEEAAEIVALIGEDNFALLEAVKEVHDIGLLAHILEGEQYLSMARVKQYDAHHEDLLQLKRVLKKYDKDEYDKMFRMMGQDNYSAYVGSVNYNENKVRRNGGKGKDVEAFYKNVKKVMDKLPEIAQNDPDVKDIRTKIEGEAFLQKQLTASNGIIPNQVHTRELKAILENASGYLPFLNEKDDSGLTVKERILELYSFQIPYYVGPLGQQHEGEKGYNVWAKRRPGEAKGRILPWNFEQKIDVNQAAEDFIKRMVRHCTYLKGENTLPKQSLLYEKFMVLNELNNLRIRGEKPSVEVKQEIYETLFMTGKRVTRKQLLKYLVANGLLNEDDGDMVSGIDQDFKASLSSLNKFKGVLGDAAVYDSNRAMIEQIIFWATIYGDDKHFLKNRIKEHYGDSLDNQQIKRICGMKFNGWGNLSKTFLELQGASKEDGVYRSIIQSLWETNDNLMQLLSERYTYSEELEKMIGDAEKPLSEWKIEDLDDMYLSPSVKRMVWQTLKILNEIVEVRGYAPDKIFVEMARDSAQTRARNKGKRTQSRKEFLLNVYKEDKEWRKEIQSCEEIKFRKKKIYLYYLQHGKSLYSGKTIDFDTLLSDNDAYDIDHIYPRHFVKDDSLENNLVLCLKSENAKKGDQYPLRKTFDSAVLSSQEGVWKSLLKQKVITKEKYDRLVRTADFTIDELAGFINRQLVETRQGTKAITQILKRVFKNEAVEIIFTKAELISDFRRIFDLPKVRCVNSTHHAHDAYLNIVVGNVYNAKFTKHPRHFIEECQRKGSYDYNMYRMFDYDVKCGSKIVWCGSKITTCGKGTISTVKKQLQKRSVLLTKKSFMKHGKLFAANNTGKESIKSDAYYSDKTTDIRLLDVQKYGGKSDISNTAFALVEFYSKGKPVRILERIPLYLNITNNNDENLNNYISKKIKKDLKNVEISEMSIRMYPIRQYVKLKINGYFYYLSGSDDDTRVSLRDAVTFYLSDEEMAYVKYIEKAVETQNFYRQKNKKAVLSEAGNIKLYEVLIEKLQQGIFLKKKISIVPVLLEGKEKFKALPLEKQCYIIMQIFAWITSNQQGVNLKDIGGASNAGKLKMSKNISDLSEAILIEQSATGLYERRIDLLTV

SEQ ID NO: 1760 - protein, 1382 aa, Unknown
  Description of Unknown: uncultivated organism with predicted taxonomy: Clostridiales
  MG23-6 effector
MDKVKQAPYYIGLDMGTSSVGWAVTDEDYKILRGKGKDMWGVRLFDEAKTAAERRTFRVARRRRQREVARIGLLREYFADAIHEVDPGFFHRLEESKYYLEDRDDDNQQKFALFNDKNFTDKEYYAQYPTIFHLRKELIESSDPHDVRFVFLAILNLFKRRGHFLNKGLSADGGESSMAEAYETLVEEARNQEIILPEALDTQALEACLGEKGLSRSTIKENVMELLVVSKKDKAATELISMMCGLKGTLQKIYGSDLIDDEHKGMKISFRDMNYEEEAAEIVALIGEDNFALLEAVKEVHDIGLLAHILEGEQYLSMARVKQYDAHHEDLLQLKRVLKKYDKDEYDKMFRMMGQDNYSAYVGSVNYNENKVRRNGGKGKDVEAFYKNVKKVMDKLPEIAQNDPDVKDIRTKIEGEAFLQKQLTASNGIIPNQVHTRELKAILEKASGYLPFLNEKDDSGLTVKERILELYSFQIPYYVGPLGQQHAGEKGYNVWAKRRPGEAKGRILPWNFEQKIDVNQAAEDFIKRMVRHCTYLKGENTLPKQSLLYEKFMVLNELNNLRIRGEKPSVEVKQDIYETLFMTGKRVTRKQLLKYLAANGLLNEDDGDMVSGIDQDFKASLSSLNKFKGVLGDAAVYDSNRAMIEQIIFWATIYGDDKHFLKNRIKEHYGDSLDDQQIKRICGMKFNGWGNLSKTFLELQGASKEDGVYRSIIQSLWETNDNLMQLMSERYTYTEKLEKMVGDAEKPLSEWKIEDLDDLYLSPSVKRMVWQTLKILNEIVEVRGYAPDKIFVEMARDSAQTRARNKGKRTQSRKDFLINAYKEDKEWRKEIESRDEAEFRIKKLYLYYVQMGRCMYSGEAIDLHALMAGNEQYDIDHIYPRHFVKDDSLENNLVLVKKTINAHKSDTFPLEAELRKKQYAFWRSLLDRGLITQNKFNRLTRATGFSNEELAGFINRQLVETRQGTKAITQILKEAFKNDDTRIVFTKAEVTADFRHKYDLPKARSVNNLHHAHDAYLNIVAGNVYDAKFTSHPINFIKECRNKGVFNYNMAKVFDYNVKRGNRYVWIAQNDGMDMPLTIERVKNQLARNTILMTRRSYMAHGGISNKATIYGKDTAKPGSYLPVKSSDSRLSDVTKYGGITSVLNTAYALVEYKVKGKMVRSLESVPLYVDATGKDDEKLLNYLRESLQFENKKNLVENVSVRLYPVRQRSLLKLDGYYYHLGGGAGSMFYLIDAVPMYLPQKVVMYIKKIEKAMETQRYDEINSKNEVIITKENNAETYDLLLHKLTKGIYSHRKASIINILVNGEEKFDSLNLEAQCSVILKIFAWINSSQQTVDLKDIGGSANSGFLKTSRKLSNSTEAILIEQSATGLYERRIDLLTV

SEQ ID NO: 1761 - protein, 1371 aa, Unknown; identical to SEQ ID NO: 1758
  Description of Unknown: uncultivated organism with predicted taxonomy: Clostridiales
  MG23-7 effector

SEQ ID NO: 1762 - protein, 1371 aa, Unknown
  Description of Unknown: uncultivated organism with predicted taxonomy: Clostridiales
  MG23-8 effector
MEERKMYWGLDLGTNSVGWAVTDQNYQLMRAKGKDLWGARLFDRADTSAERRGYRVSRRRRQREVARCGVLKEYFYEEISKMDAGFFVRLEESKFWKEDRSEGNQQKYALFADANFTDKDYFEKYPTIFHLRKELLETSEAHDVRLVYLALLNMFKHRGHFLNTALSAEETETDMNAAYQELVDTAGYFDIAFDPQLDAREIENILGEKGISRSRILEKLSTYMGISKSDKAAYELLKLVCGNAGKLVNIYGSEILGEENKTLSISFRDSNYEEKETQVKELVGDDYFELLLAAKAVHDIGLLANILKGHAYLTYARVESYEEHKKDLQLLKCVLKKYNQEGYDKMFRVMEPGNYSAYIGSVNSKESGKVRRNEGKGRSREDLYKTIRKLLGQCPQDDQDVALILSKIESETFLPKQLTADNGVIPNQVYVKEMRKILKNAATYLPFLKEKDESQLTVAERIIQLFSFRIPYYIGPLGQEHLDEKGYNEWARRIAPGKVYPWNLEEKFDTKEAAEKFIERMVRHCSYLTQEKTLPKNSLLYEKFMVLNELNNLKIHGEKITVEQKQDLYNSLFIKGKRVSIAQIVRHCQLSGWVEKDDTDFLSGIDLTGFKASLSSVGKFRGVFGEGFFNDKQTAMAEQIIFWATVYGNDKSYLRERIEEEYSELLDEKQIKRILGFKFEGWGNLSREFLYLRGTSRQDSERSVIMALWETNDNLMELLSERYTYKEALQEQIKEKEKTLEEWTIEDLGGMYLSAPVKRMLWQTMKILLELKQTLGQTPDRVYVEMPREDGEKGERKDSRKKKLLDLYSALKGEEKAWRKEIEDRPEADFRIKKLYLYYRQMGKCMYTGETIELADLFNDNLYDIDHIYPRHFVKDDSIENNLILVKKQKNARKGDSYPIEREIQRARYQLWKMLADKNFISREKHQRLIRTTPFSEEEKAGFISRQLVETRQGTKAITQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVHGGITRKDTIYNKETAKGQGYIAVKGSDPRLCDVTKYGGRTSINNMFYTLASYRVKGKSVLSLEAIPGYLGNAENISDETLLRYLQDSLEKENPGKVISDLQIKYRCIRYKSLLKIDGFYYYIVGKTGKQIYLESAVPLILNNEDAIYLKKIEKAVSGQYFEEKREGQLIITEECNQKLYDILLEKLTDGIYRNKKASLQTILQEGREKFIRLSIPNQCQILMNLVGWFQLSCVTADMKEIGGSVNSGKCLMGKKISDCSEMILITQSATGLQERRIDLLKL

SEQ ID NO: 1763 - protein, 1371 aa, Unknown
  Description of Unknown: uncultivated organism with predicted taxonomy: Clostridiales
  MG23-9 effector
MEERKMYWGLDLGTNSVGWAVTDQNYQLMRAKGKDLWGARLFDRADTSAERRGYRVSRRRRQREVARCGVLKEYFYEEISKMDAGFFVRLEESKFWKEDRSEGNQQKYALFADANFTDKDYFEKYPTIFHLRKELLETSEAHDVRLVYLALLNMFKHRGHFLNTALSAEETETDMNAAYQELVDTAGYFDIAFDPQLDAREIENILGEKGISRSRILEKLSTYMGISKSDKAAYELLKLVCGNAGKLVNIYGSEILGEENKTLSISFRDSNYEEKETQVKELVGDDYFELLLAAKAVHDIGLLANILKGHAYLTYARVESYEEHKKDLQLLKCVLKKYNPEGYDKMFRVMEPGNYSAYIGSVNSKESGKVRRNEGKGRSREDLYKTIRKLLGQCPQDDQDVALILSKIESETFLPKQLTADNGVIPNQVYAKEMRKILKNAATYLPFLKEKDEFQLTVAERIIQLFSFRIPYYIGPLGQEHLDEKGYNEWARRIAPGKVYPWNLEEKFDTKEAAEKFIERMVRHCSYLTQEKTLPKNSLLYEKFMVLNELNNLKIHGEKITVEQKQDLYNSLFIKGKRVSIAQIVRHCQLSGWVEKDDTDFLSGIDLTGFKASLSSVGKFRGVFGEGFFNDKQTAMAEQIIFWATVYGNDKSYLRERIEEEYSELLDEKQIKRILGFKFEGWGNLSREFLYLRGTSRQDSERSVIMALWETNDNLMELLSERYTYKEALQEQIKEKEKTLEEWTIEDLGGMYLSAPVKRMLWQTMKILLELKQTLGQTPDRVYVEMSREDGEKGERKDSRKKKLLDLYSALKGEEKAWRKEIEDRPEADFRIKKLYLYYRQMGKCMYTGETIELADLFNDNLYDIDHIYPRHFVKDDSIENNLILVKKQKNARKGDSYPIEREIQRARYQLWKMLADKNFISREKHQRLIRTTPFSEEEKAGFISRQLVETRQGTKAITQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVHGGITRKDTIYNKETAKGQGYIAVKGSDPRLCDVTKYGGRTSINNMFYTLASYRVKGKSVLSLEAIPGYLGNAENISDETLLRYLQDSLEKENPGKVISDLQIKYRCIRYKSLLKIDGFYYYIVGKTGKRICLESAVPLILNNEDAIYLKKIEKAVSGQYFEEKREGQLIITEECNQKLYDILLEKLTDGIYRNKKASLQTILQEGREKFIRLSIPNQCQILMNLVGWFQLSCVTADMKEIGGSVNSGKCLMGKKISDCSEMILITQSATGLQERCIDLLKL

SEQ ID NO: 1764 - protein, 1389 aa, Unknown
  Description of Unknown: uncultivated organism with predicted taxonomy: Clostridiales
  MG23-10 effector
MEINLENNAEEIIMGKKMYIGIDMGTSSVGMAVTDENYTLYRVKGKDFWTSRLFKEANTAAERRTNRVARRRRQRETARMGILRELFSEEINKVDEGFFARLDESKYHIEDRVVKQKYALFADKGYTDKEYYKEYPTIFHLRNELLHPQKNSYDVRLVYLAIANMFKHRGNFLNETLDIDKITANAVDVYSQLVEELDLYCIQMPVSIDIGKLMNIIGENGISRSKRLENASKYLGITKKDKQSYEILKLICGLKGILYNIYGENVIDEENKKFSLSFTGSIYEDSEAQAKDILGDEYFELIEIIKELHDICVLSGIIKGHKFLSEARVELYEEHKKDLDMLQQVLKKYDKNAYDEMFRVMKEGNYSAYVGSVNARGKNKKIRRNVGEGKKGKNGRSQETFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKRDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNETCELTGRLPDKIFVEMPREHESGNERKASRKKKMLDLYKAIKSEQKQWAEHMIAEIDKSDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVIKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDENGQIIITGERNMKFFNTLGSKLNARPYNNNRWNIYKIMENKEEIFAGLSIEKQCYVINQIISWINSKTQNVDLSDIKGSSHSGTMPLNKKISECSQFELIYQSVTGMYEKRTDLLKL

SEQ ID NO: 1765 - protein, 1368 aa, Unknown
  Description of Unknown: uncultivated organism with predicted taxonomy: Butyrivibrio sp. CAG:318
  MG23-11 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1766 - protein, 1109 aa, Unknown
  Description of Unknown: uncultivated organism with predicted taxonomy: Butyrivibrio sp. CAG:318
  MG23-12 effector
LCLERSERNDKNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLENNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1767 - protein, 1389 aa, Unknown
  Description of Unknown: uncultivated organism with predicted taxonomy: Clostridium sp. AF36-4
  MG23-13 effector
MEINLENNAEEIIMGKKMYIGIDMGTSSVGMAVTDENYNLYRVKGKDFWTSRLFKEANTAVERRTNRVSRRRRQRETARMGILRELFSEEINKVDEGFFARLDESKYHIEDRDVKQKYALFADKGYTDKEYYKEYPTIFHLRNELLHPQKDSYDVRLVYLAIANMFKHRGNFLNETLDIDKITASADDVYSQLIEELDLYCIQMPVNINIGELINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIKPLSEWTIDNLEDYYMSAPVKRMVWQTVKMLNETCELTGRVPDKIFVEMPREHESGNERKASRKKKMLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGVTKQHVLKTINRNTVTITRKTEEVHGALSNKVTVWSSKSAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMEFFNTLGSKLNARPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1768 - protein, 1368 aa, Unknown
  Description of Unknown: uncultivated organism with predicted taxonomy: Butyrivibrio sp. CAG:318
  MG23-14 effector
MDKKMYVGIDMGTNSVGMAVTDEEYNLYRVKGKDLWCSRLFTEADTAAERRTNRISRRRRQREVARMGVLRELFAEEINKVDEGFFARLDESKYHLEDRDSEQKYTLFTDTGYTDKDYFKDYPTIFHLRNELLHPVKDSYDVRLVYLAIANMFKHRGNFLNESLDADKITSSADETYQQLIEMAMMYSIEFPKNINVEKFIDIIGENGVSRSKHLENVCEYLGITKKDKPAYEILNLVCGLRGVLINIYGNEVIDEENKKFSICFRDSNYEEKEGEALELLGDEYFELLETIKEIHDIGMLAGIIKGHKYISEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHASELKAILTNAEKYLPFLLGKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLKIDGKKPSVQVKQGIYEELFKTGKRVTLKQLKKYLYNNSIIASEENVVIEGIDGGFNSSLTSVGKFRGVLGDELFTDANQAMAEEIIFWGTVYGNDKKFLKDEIESKYGTVLSKDQIKRILGFKFNGWGNLSKTCLELQGSCECGDCSLIQALWETNHNLMELLSEQYGFKKELDALACNVEKPLTEWTIDDLDNKYLSAPVKRMVWQTIKMLREVCELTNKEPDRVFVEMPREHGKENDRKTSRKKKILDLYSALKREKKEWAELKIREIEGRTEADFRIKKLYLYYLQQGRCMYSGEKIELNDLFNNNLYDIDHIYPRHFIKDDSLENNLVLVKKEINNHKSDNYPLESDIRKNMNEFWKSLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLIEYKVKGKKVRSLEALPVYLGRSNTLTDEDIMQYISNVLQKEYAGKEISDLSVRVPFVPQKSKVRVDGFEYYLGGKTGNYICLNNAMPLYLSGNDEEYLRKIMKAIEIDNYEEIDKDSNAIITEEKNAALFNTLSVKLNSEPYINNQWNIYKILEGKEEIFKDLDIQKQCYVIVKIIDWIKSKTQGVDLTDIQGKNQSGTMKVNKRISECKECILIHQSVTGMYERRIDLLSI

SEQ ID NO: 1769 - protein, 1366 aa, Unknown
  Description of Unknown: uncultivated organism with predicted taxonomy: Butyrivibrio sp. CAG:318
  MG23-15 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKESYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGNEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKIPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSLLYEKFMVLNELNNLKIAGKKPSVQVKQDIYEKLFKPGKKVTLKQLQEYLCNNSIIASKEDIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGNCSLIQALWETNHNLMELLSEQYGFKKELDALACNVEKPLTEWTIDDLDNKYLSAPVKRMVWQTIKMLREVCELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLREQNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDVYMPVKTSDTKAQDVTKYGGITSIANSGYTLVEYKVKGKKVRSLEALPVYLGRSNALTNEDIMQYISAALQKEYAGKEISDLSVRVPFVPQKSKVRVDGFEYYLGGKTEKNIYLNNTMPLYLSWNDEEYLRKIMKAIDIDSYEEIDKDGNAIITEEKNVALFGALSVKLNSEPYINNRWNIYKILDGKEEIFKNLDIKKQCYVISQIIAWINSSTPNVNLKDVCGSEHSGMQRLNKKISECKECILIHQSVTGMYERRIDLLSI

SEQ ID NO: 1770 - protein, 1389 aa, Unknown; identical to SEQ ID NO: 1767
  Description of Unknown: uncultivated organism with predicted taxonomy: Clostridium sp. AF36-4
  MG23-16 effector

SEQ ID NO: 1771 - protein, 1366 aa, Unknown
  Description of Unknown: uncultivated organism with predicted taxonomy: Butyrivibrio sp. CAG:318
  MG23-17 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSRDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1772 - protein, 1389 aa, Unknown
  Description of Unknown: uncultivated organism with predicted taxonomy: Clostridiales
  MG23-18 effector
MEINLENNAEEIIMGKKMYIGIDMGTSSVGMAVTDENYNLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGTTKQHVIKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMKIFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1773 - protein, 1368 aa, Unknown; identical to SEQ ID NO: 1768
  Description of Unknown: uncultivated organism with predicted taxonomy: Butyrivibrio sp. CAG:318
  MG23-19 effector

SEQ ID NO: 1774 - protein, 1368 aa, Unknown; identical to SEQ ID NO: 1765
  Description of Unknown: uncultivated organism with predicted taxonomy: Butyrivibrio sp. CAG:318
  MG23-20 effector

SEQ ID NO: 1775 - protein, 993 aa, Unknown
  Description of Unknown: uncultivated organism with predicted taxonomy: Butyrivibrio sp. CAG:318
  MG23-21 effector
MDKKMYVGIDMGTNSVGMAVTDEEYNLYRVKGKDLWCSRLFTEADTAAERRTNRISRRRRQREVARQGVLRELFAEEINKVDEGFFARLDESKYHLEDRDSEQKYTLFTDTGYTDKDYFKDYPTIFHLRNELLHPVKDSYDVRLVYLAIANMFKHRGNFLNESLDADKITSSADESYRSLVETAMMYSIEFPENINVKKFIDIIGENGVSRSKHLENVCEYLEITKKDKQAYEILKLICGMSGVLINIYGNEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMRAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALACNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESDIRKNMNEFWKSLREKNFISKEKYSRLIRTEEFTDEEKAAFISRQLVETRQGTKAITQVLKQAFPNTQIVFVKAGIVSDFRKKFDINKVRALND

SEQ ID NO: 1776 - protein, 1368 aa, Unknown; identical to SEQ ID NO: 1765
  Description of Unknown: uncultivated organism with predicted taxonomy: Butyrivibrio sp. CAG:318
  MG23-22 effector

SEQ ID NO: 1777 - protein, 1366 aa, Unknown
  Description of Unknown: uncultivated organism with predicted taxonomy: Butyrivibrio sp. CAG:318
  MG23-23 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1778 - protein, 1383 aa, Unknown
  Description of Unknown: uncultivated organism with predicted taxonomy: Clostridiales
  MG23-24 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDICVLSGIIKGHKFLSEARVELYEEHKNDLDMLQQVLKKYDKNAYDEMFRVMKEGNYSAYVGSVNACGKNKKIRRNGGKGRSQEDFYKYVKTTLKNYPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGNDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESSNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMEFFNTLGSKLNARPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1779 - protein, 1368 aa, Unknown
  Description of Unknown: uncultivated organism with predicted taxonomy: Butyrivibrio sp. CAG:318
  MG23-25 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKESYDVRLVYLAIANMFKHRGNFLNESLDADKITSSADEAYRSLVETAMMYSIEVPENINVKKFIDIIGENGVSRSKHLENVCEYLEITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFQEDDEEIKTILSEIDSETFMPKQLTASNGVIPNQLHVSELKAILTNAEEYLPFLLGKDESGLTVSERIVELFRFHIPYYVGPIGAQGENVWAKRRPGEENGKVYPWNFEQKIDIQSAAKEFINRMVRHCTYLSGERTLPKQSFLYEKFMVLNELNNLKIDGKKPSVQVKQGIYEELFKTGKRVTLNRLKDYLYNNSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALACNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKNIYLNNAMPLYLSWNDEEYLRKIMKAIEIDNYEEIDKYSNAIITEEKNVALFDVLSVKLNSEPYINNRWNICKTLEGKEEIFKNLDIKKQCYVIGQIISWINSAMQNVNLKDVCGSEHSGMQQLNKKISECKECILIHQSVTGMYERRIDLLSI

SEQ ID NO: 1780 - protein, 1368 aa, Unknown; identical to SEQ ID NO: 1765
  Description of Unknown: uncultivated organism with predicted taxonomy: Butyrivibrio sp. CAG:318
  MG23-26 effector

SEQ ID NO: 1781 - protein, 829 aa, Unknown
  Description of Unknown: uncultivated organism with predicted taxonomy: Butyrivibrio sp. CAG:318
  MG23-27 effector
MVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1782 - protein, 1366 aa, Unknown; identical to SEQ ID NO: 1777
  Description of Unknown: uncultivated organism with predicted taxonomy: Butyrivibrio sp. CAG:318
  MG23-28 effector

SEQ ID NO: 1783 - protein, 1368 aa, Unknown; identical to SEQ ID NO: 1765
  Description of Unknown: uncultivated organism with predicted taxonomy: Butyrivibrio sp. CAG:318
  MG23-29 effector

SEQ ID NO: 1784 - protein, 1366 aa, Unknown
  Description of Unknown: uncultivated organism with predicted taxonomy: Butyrivibrio sp. CAG:318
  MG23-30 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGNCSLIQALWETNHNLMELLSEQYGFKKELDALACNVEKPLTEWTIDDLDNKYLSAPVKRMVWQTIKMLREVCELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLREQNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDVYMPVKTSDTKAQDVTKYGGITSIANSGYTLVEYKVKGKKVRSLEALPVYLGRSNALTNEDIMQYISAALQKEYAGKEISDLSVRVPFVPQKSKVRVDGFEYYLGGKTEKNIYLNNTMPLYLSWNDEEYLRKIMKAIDIDSYEEIDKDGNAIITEEKNVALFGALSVKLNSEPYINNRWNIYKILDGKEEIFKNLDIKKQCYVISQIIAWINSSTPNVNLKDVCGSEHSGMQRLNKKISECKECILIHQSVTGMYERRIDLLSI

SEQ ID NO: 1785 - protein, 1368 aa, Unknown; identical to SEQ ID NO: 1765
  Description of Unknown: uncultivated organism with predicted taxonomy: Butyrivibrio sp. CAG:318
  MG23-31 effector

SEQ ID NO: 1786 - protein, 1366 aa, Unknown
  Description of Unknown: uncultivated organism with predicted taxonomy: Butyrivibrio sp. CAG:318
  MG23-32 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1787 - protein, 1389 aa, Unknown
  Description of Unknown: uncultivated organism with predicted taxonomy: Clostridiales
  MG23-33 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSLIDSKEVMITGIDGGFKSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIKPLSEWTIDNLEDYYMSAPVKRMVWQTVKMLNETCELTGRVPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDENGQIIITSERNMKFFNTLSSKLNARPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1788 - protein, 1368 aa, Unknown
  Description of Unknown: uncultivated organism with predicted taxonomy: Butyrivibrio sp. CAG:318
  MG23-34 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLVCGMSGVLINIYGDEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAQRRPGEEKGRVYPWNFEQKIDTQSAAKEFINRMVRHCTYLSGERTLPKQSFLYEKFMVLNELNNLRIDGKKPSVQVKQGIYEELFKTGKRVTLNKLKDYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGLCECGDCSLIQALWETNHNLMELLSEQYGFKKELDALACNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAISQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPVYLGRSNALTNEDIMQYISAALQKEYAGKEISDLSVRVPFVPQKSKVRVDGFEYYLGGKTGNRICLNNAMSLYLSENDEEYLRKIMKAIEIDNYEEIDKDSNAIITEEKNVDLFDVLSVKLNSEPYINNRWNIYKTLDGKKEIFENLDIKKQCYVISQIIFWINSSTQSVNLKDVCGSEHSGMQPLNKKISECKECILIHQSVTGMYERRIDLLSI

SEQ ID NO: 1789 - protein, 1180 aa, Unknown
  Description of Unknown: uncultivated organism with predicted taxonomy: Butyrivibrio sp. CAG:318
  MG23-35 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEEYLPFLLGKDESGLTVSERIVELFRFHIPYYVGPIGAQGENVWAQRRPGEEKGRVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQILKQAFPNTQIVFVKAGIVSDFRKKFDINKVRALNDTHHAKDAYLNIVVGNTYYTKFTNNPMNFIKDASKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYMSHV

SEQ ID NO: 1790 - protein, 1389 aa, Unknown
  Description of Unknown: uncultivated organism with predicted taxonomy: Clostridiales
  MG23-36 effector
MEINLENNAEEIIMGKKMYIGIDMGTSSVGMAVTDENYNLYRVKGKDFWTSRLFKEASTAANRRTNRVARRRRQRELARMGILRELFSEEINKVDEGFFARLDESKYHIEDRDVKQKYALFADKGYTDKEYYKEYPTIFHLRNELLHPQKDSYDVRLVYLAIANMFKHRGNFLNETLDIDKITANAVDVYSQLIEQLDLYCIQMPVSIDIGKLINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVIHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWSKLSKRFLELKGSCECGECSIIQALWQTNHNLMELMSDQYDFKTNLMELSEETIKPLSEWTIDNLEDYYMSAPVKRMVWQTVKMLNETCELTGRVPDKIFVEMPREHESGNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMEFFNTLGSKLNARPYNNNRWNIYKIMDNKEEIFAGLSIEKQCYVINQIISWINSKTQNVDLSDIKGSSHSGTMTLNKKISDCSQFELIYQSVTGMYEKRTDLLKL

SEQ ID NO: 1791 - protein, 1389 aa, Unknown
  Description of Unknown: uncultivated organism with predicted taxonomy: Clostridiales
  MG23-37 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIDELDLYCIQMPVSIDIGKLINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILVEDLFTDSNQAMVEQIIFWGTIYGNDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESSNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKGTVWSSKLAKKNPDAYMPVKTTDEKACDVKKYGGITAIANSGYTLVEYNINGKMIRSIEALPVYLGRKNMLTDDKIREYLHEKIRKEYKNKTVTDLKVCILFIPQKSKVCVDGFNYYLGGVTGNSIYLSNAEPLYLSKEDEEYLRKIIKAVDKGYYEETDKNGQIIITGERNMKIFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1792 - protein, 1368 aa, Unknown; identical to SEQ ID NO: 1765
  Description of Unknown: uncultivated organism with predicted taxonomy: Butyrivibrio sp. CAG:318
  MG23-38 effector

SEQ ID NO: 1793 - protein, 1366 aa, Unknown; identical to SEQ ID NO: 1784
  Description of Unknown: uncultivated organism with predicted taxonomy: Butyrivibrio sp. CAG:318
  MG23-39 effector

SEQ ID NO: 1794 - protein, 1366 aa, Unknown
  Description of Unknown: uncultivated organism with predicted taxonomy: Butyrivibrio sp. CAG:318
  MG23-40 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEDIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESDIRKNMNKFWKSLREKNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKNLDIKKQCYIIGQIISWINSSTQNVNLKDVCGSEHSGMQRLNKKISECKECILIHQSVTGMYERRIDLLSI

SEQ ID NO: 1795 - protein, 958 aa, Unknown
  Description of Unknown: uncultivated organism with predicted taxonomy: Clostridiales
  MG23-41 effector
MPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTVKMLNETCELTGRVPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLYEKIRKEYKNKTVTDLKVCILFIPQKSKVCVDGFNYYLGGVTGNSIYLSNAEPLYLSKEDEEYLRKIIKAVGKGYYEETDKNGQIIITGERNMKFFNTLGSKLNARPYNNNRRNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1796 - protein, 1366 aa, Unknown
  Description of Unknown: uncultivated organism with predicted taxonomy: Butyrivibrio sp. CAG:318
  MG23-42 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKNIYLNNAMPLYLSWNDEEYLRKIMKAIEIDNYEEIDKYSNAIITEEKNVALFDVLSVKLNSEPYINNRWNICKTLEGKEEIFKNLDIKKQCYVIGQIISWINSAMQNVNLKDVCGSEHSGMQQLNKKISECKECILIHQSVTGMYERRIDLLSI

SEQ ID NO: 1797 - protein, 1368 aa, Unknown
  Description of Unknown: uncultivated organism with predicted taxonomy: Butyrivibrio sp. CAG:318
  MG23-43 effector
MDKKMYVGIDMGTNSVGMAVTDEEYNLYRVKGKDLWCSRLFTEADTATERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1798 - protein, 1366 aa, Unknown
  Description of Unknown: uncultivated organism with predicted taxonomy: Butyrivibrio sp. CAG:318
  MG23-44 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKNRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLENNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1799 - protein, 1042 aa, Unknown
  Description of Unknown: uncultivated organism with predicted taxonomy: Butyrivibrio sp. CAG:318
  MG23-45 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIF

SEQ ID NO: 1800 - protein, 1376 aa, Unknown
  Description of Unknown: uncultivated organism with predicted taxonomy: Clostridiales
  MG23-46 effector
MGKNMYIGVDMGTSSDGVAVTDENYTLYRVKGKDLWTSRLFKEANTAAERRTNRVSRRRRQRETARMGILRELFSEEINKVDEGFFARLDESKYHIEDRVVKQKYALFVDKGYTDKEYYKEYPTIFHLRNELLHPQKNSYDVRLVYLAVANMFKHRGNFLNETLDIDKITANAVDVYSQLIEELDLYCIQMPVSIDIGKLINIIGENGISRSKRLENASKYLGITKKDKQSYEILKLICGLKGILYNIYGENVIDEENKKFSLSFTDSNYEDEETQAKDILGDEYFELIEIIKELYDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNYPDDDENIKNILFKIENETFMPKQLTASNGIIPNQLHAAELKAILTNAEKYLPFLLDKDESDLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTIKMLNEICELTGRIPDKIFVEMPREHENGNERKASRKKKLLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIKKDMSGFWKYLCEKKFITKEKYNRLMRTDKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKICILFIPQKSKVCVDGFNYYLGGVTGNSIYLSNAEPLYLSKEDEEYLRKIIKAVGKGYYEETDENGQIIITGERNMKFFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1801 - protein, 1366 aa, Unknown
  Description of Unknown: uncultivated organism with predicted taxonomy: Butyrivibrio sp. CAG:318
  MG23-47 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESDIRKNMNKFWKSLREKNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKNLDIKKQCYIIGQIISWINSSTQNVNLKDVCGSEHSGMQRLNKKISECKECILIHQSVTGMYERRIDLLSI

SEQ ID NO: 1802 - protein, 1368 aa, Unknown; identical to SEQ ID NO: 1765
  Description of Unknown: uncultivated organism with predicted taxonomy: Butyrivibrio sp. CAG:318
  MG23-48 effector

SEQ ID NO: 1803 - protein, 993 aa, Unknown
  Description of Unknown: uncultivated organism with predicted taxonomy: Clostridiales
  MG23-49 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKCILYNIYGENVIDEENKKFSISFTDSNYEDEETQAKDILGDEYFELIEIIKELHDICVLSGIIKGHKFLSEARVELYEEHKNDLDMLQQVLKKYDKNAYDEMFRVMKEGNYSAYVGSVNARGKNKKIRRNGGKGRSQEDFYKYVKTTLKNYPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGNDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESSNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSD

SEQ ID NO: 1804 - protein, 1386 aa, Unknown
  Description of Unknown: uncultivated organism with predicted taxonomy: Clostridiales
  MG23-50 effector
MDRDDKKMYVGIDMGTNSVGLAVTDEKYNLYRVKGKDFWCSRIFSKAETAEVRRVNRISRRRRQRETARQGILREFFAEEINKVDEGFFARLDESKYHIEDRENQQKYTLFIDNGYTDKEYYAEYPTIFHLRNELLHPQKDSYDVRLVYLAISNMFKHRGNFLNETLDMGKVTSSAGDIYQQLVEEAMLYVIELPVSIDVERLINIIGEKGVSRSKHLENVSSYLGITKKDKSAYEILKLVCGMSGLLFNIYGEEIIDEENKKFSLNFRDTNYEEKEGQALELLGNDNFQLIEIIKELHDIGVLSSIIKGHKFLSESRVELYEEHKKDLDMLQAVLKRYDKKAYNDMFRIMKEGNYSAYVGSVNSIGQNEKRSEKCQKQKIRRNRGKGSSQEVFYKYVKSVLKKLPEDDKDVKKIMEKIENETFMPKQLTASNGVMPNQLHTVELRAILENAEKYLPFLLNKDESGLTVSQRIVELFKFHIPYYVGPIGAGGQNVWAKRRKGEEKGRIYPWNFEQKIDTQAAAEEFIGRMVRHCTYLANERTLPKQSLLYEKYMVLNELNNMKINGIKPDVSVKQGIYNDLFKKGKRVTLNALKSYLYNNSIIESKEDVVITGIDIVHNGGFSASLTSVGKFIGVLGDELFTDENQTMVEQIIFWGTVYGNDKKFLKNRIQETYAGRLTWEQIKRIAGFKFNGWGNLSKAFLELKGNCECGECSIIQALWETNHNLMELLADQYDFKKNLEAMSNNVEKPLQEWTIEDLEGKYLSAPVKRMVWQTVKMLREVCELTGRQPDKVFVEMPREEGIKNERKNSRKKKLLELYTSIKNEQKAWSEVKIREIDGRTETDFRIKKLYLYYLQHGKCMYSGEKIELNDLFNNNLYDIDHIYPRHFIKDDSIENNLVLVKKQINNHKSDTFPIESSIQKNMMTFWKTLVEHNFITKEKYNRLMRTEEFTDEEKAAFISRQLVETRQGTKAVTQILKQAFPDTQIIFVKAGVVSDFRKKFNINKVRALNDTHHAKDAYLNIVVGNIYNTKFTSNPINFIKDARKNVNDISYKYNMDKMFDYNVCRNGENAWIADNGKSKQHVLSVLGKNSVIITRKTEENHGALSNKVTVWSKDTAKKNPGAYMPVKTTDSKAQDVTKYGGITSIASSGYTLIEYKVKGKTIRSIEALPVYLGKSDTLTEERILEYIGVNLKKEYKDKEISDIKVCVKFIPFKSKIRIDGFNYYLGGKTGNYIYLNNDEALYLNNNDEEYLRKITKAIDITNYEEIDENGNVIITQEKNTKLFNVLCEKLNNKPYRYNRWNIYNVLEGKEETFRKLDVEKQCYIINQIILWVNSAVQNINLKYINGKEHEGSLHMNKKISEYDEAVLIQQSVTGMYERKTDLLKV

SEQ ID NO: 1805 - protein, 1389 aa, Unknown
  Description of Unknown: uncultivated organism with predicted taxonomy: Clostridiales
  MG23-51 effector
MEINLENNAEEIIMGKKMYIGIDMGTSSVGMAVTDENYTLYRVKGKDFWTSRLFKEANTAAERRTNRVARRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTIKMLNEICELTGRIPDKIFVEMPREHENGNERKASRKKKLLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKSAEKNPDAYMPVKTTDEKAGDVTKYGGITAIANSGYTLIEYNINGKMIRSIEALPVYLGRKNMLTDDKIKEYLHEKIRKEYKNKTVTDLKVCILFIPQKSKVCVDGFNYYLGGVTGNSIYLSNAEPLYLSKEDEEYLRKIIKAVSKGYYEETDKNGQIIITDERNMKFFNTLGSKLNARPYCNNRWNIYKIMENKEEIFAGLSIEKQCYVINQIISWINSKTQNVDLSDIKGGSHSGTMTLNKKISECSQFELIYQSVTGMYEKRTDLLKL

SEQ ID NO: 1806 - protein, 1366 aa, Unknown
  Description of Unknown: uncultivated organism with predicted taxonomy: Butyrivibrio sp. CAG:318
  MG23-52 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVFRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKNIYLNNAMPLYLSWNDEEYLRKIMKAIEIDNYEEIDKYSNAIITEEKNVALFDVLSVKLNSEPYINNRWNICKTLEGKEEIFKNLDIKKQCYVIGQIISWINSAMQNVNLKDVCGSEHSGMQQLNKKISECKECILIHQSVTGMYERRIDLLSI

SEQ ID NO: 1807 - protein, 1368 aa, Unknown; identical to SEQ ID NO: 1765
  Description of Unknown: uncultivated organism with predicted taxonomy: Butyrivibrio sp. CAG:318
  MG23-53 effector

SEQ ID NO: 1808 - protein, 1366 aa, Unknown; identical to SEQ ID NO: 1777
  Description of Unknown: uncultivated organism with predicted taxonomy: Butyrivibrio sp. CAG:318
  MG23-54 effector

SEQ ID NO: 1809 - protein, 1368 aa, Unknown; identical to SEQ ID NO: 1765
  Description of Unknown: uncultivated organism with predicted taxonomy: Butyrivibrio sp. CAG:318
  MG23-55 effector

SEQ ID NO: 1810 - protein, 1114 aa, Unknown
  Description of Unknown: uncultivated organism with predicted taxonomy: Butyrivibrio sp. CAG:318
  MG23-56 effector
FFITCLCLERSERNDKNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1811 - protein, 829 aa, Unknown; identical to SEQ ID NO: 1781
  Description of Unknown: uncultivated organism with predicted taxonomy: Butyrivibrio sp. CAG:318
  MG23-57 effector

SEQ ID NO: 1812 - protein, 1366 aa, Unknown
  Description of Unknown: uncultivated organism with predicted taxonomy: Butyrivibrio sp. CAG:318
  MG23-58 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSRDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGNAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1813 - protein, 1389 aa, Unknown
  Description of Unknown: uncultivated organism with predicted taxonomy: Clostridiales
  MG23-59 effector
MEINLENNAEEIIMGKKMYIGIDMGTSSVGMAVTDENYNLYRVKGKDFWTSRLFKEASTAANRRTNRVARRRRQRELARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIRPLSEWTIDNLEDYYMSAPVKRMVWQTVKMLNETCELTGRIPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGVTKQHVLKTINRNTVTITRKTEEVHGALSNKVTVWSSKSAKKNPDAYMSVKTTDEKACDVTKYGGFTAIANSGYTLVEYNINGKMIRSIEALPVYLGRKNMLTDDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMKFFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1814 - protein, 1389 aa, Unknown
  Description of Unknown: uncultivated organism with predicted taxonomy: Clostridiales
  MG23-60 effector
MEINLENNAEEIIMGKKMYIGIDMGTSSVGMAVTDENYNLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQVLWQTNHNLMELMSDQYDFKTNLMELSEETIKPLSEWTIDNLEDYYMSTPVKRMVWQTVKMLNETCELTGRVPDKIFVEMPREHESGNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKATFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGTTKQHVIKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMKFFNTLGSKLNARPYNNNRWNIYKIMDNKEEIFAGLSIEKQCYVINQIISWINSKTQNVDLSDIKGSSHSGTMTLNKKISDCSQFELIYQSVTGMYEKRTDLLKL

SEQ ID NO: 1815 - protein, 881 aa, Unknown
  Description of Unknown: uncultivated organism with predicted taxonomy: Clostridiales
  MG23-61 effector
MGKNMYIGVDMGTSSVGMAVTDENYTLYRVKGKDFWTSRLFKEANTAAERRTNRVARRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVTDEENKKFSISFTDSNYEDEETQAKDILGDEYFELIEIIKELHDIGVLSGIIKGHKFLSEARVELYEEHKKDLDMLEQVLKKYDKNAYDEMFRVMKEGNYSAYVGSVNARGKNKKIKRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNKAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTIKMLNEICELTGRIPDKIFVEMPREHENGNERKASRKKKLLDLYKAIKSEQKQWAEQMIAEIDKRDEADFRIKKLYLYYIQQGKCMYSGDTIDLDLLLKNNNIYDIDHIYPRHFIKD

SEQ ID NO: 1816 - protein, 1368 aa, Unknown; identical to SEQ ID NO: 1788
  Description of Unknown: uncultivated organism with predicted taxonomy: Butyrivibrio sp. CAG:318
  MG23-62 effector

SEQ ID NO: 1817 - protein, 1366 aa, Unknown
  Description of Unknown: uncultivated organism with predicted taxonomy: Butyrivibrio sp. CAG:318
  MG23-63 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1818 - protein, 1376 aa, Unknown; identical to SEQ ID NO: 1800
  Description of Unknown: uncultivated organism with predicted taxonomy: Clostridiales
  MG23-64 effector

SEQ ID NO: 1819 - protein, 1389 aa, Unknown
  Description of Unknown: uncultivated organism with predicted taxonomy: Clostridiales
  MG23-65 effector
MEINLENNAEEIIMGKKMYIGIDMGTSSVGMAVTDENYNLYRVKGKDFWTSRLFKEANTAAKRRTNRVSRRRRQRETARMGILRELFSEEINKVDEGFFARLDESKYHIEDRVVKQKYALFADKEYTDKEYYKEYPTIFHLRNELLHPQKNSYDVRLVYLAVANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSLSFTDSNYEDEETQAKDILGDEYFDLIEIIKELHDIGVLSGIIKGHKFLSEARVELYEEHKKDLDMLQQVLKKYDKNAYDEMFRVMKEGNYSAYVGSVNARGKNKKIRRNVGEGKKGRNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKRDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNETCELTGRLPDKIFVEMPREHESGNERKASRKKKMLDLYKAIKSEQKQWAEHMIAEIDKSDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVIKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDENGQIIITGERNMKFFNTLGSKLNARPYNNNRWNIYKIMENKEEIFAGLSIEKQCYVINQIISWINSKTQNVDLSDIKGSSHSGTMPLNKKISECSQFELIYQSVTGMYEKRTDLLKL

SEQ ID NO: 1820 - protein, 1368 aa, Unknown
  Description of Unknown: uncultivated organism with predicted taxonomy: Butyrivibrio sp. CAG:318
  MG23-66 effector
MDKKMYVGIDMGTNSVGMAVTDEEYNLYRVKGKDLWCSRLFTEADTAAERRTNRISRRRRQREVARQGVLRELFAEEINKVDEGFFARLDESKYHLEDRDSEQKYTLFTDTGYTDKDYFKDYPTIFHLRNELLHPVKDSYDVRLVYLAIANMFKHRGNFLNESLDADKITSSADESYRSLVETAMMYSIEFPENINVKKFIDIIGENGVSRSKHLENVCEYLEITKKDKQAYEILKLICGMSGVLINIYGNEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIAGKKPSVQVKQGIYEELFKTGKRVTLNKLKDYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQILKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWISDNGKTKQHVLRIMKKNSVTITVKTEEAHGALSNKVTVWSKEKAKGNPDAYMPVKTSDIKAQDVTKYGGITAIANSGYTLVEYKVKGKKVRSLEALPVYLGRSNALTNEDIMQYISAALQNEYAGKEISDLSVRVPFVPQKSKVRIDGFEYYLGGKTGKSVYLSNAMPLYLSGNDEEYLRKIMKAIEIDNYEEIDKDSNAIITEEKNVALFDVLCVKINSEPYINNRWNIYKILEGKEEIFKNLDIEKQCYIIGQIISWINSSTQNVNLKDVCGSEHSGMQQLNKKISECKECILIHQSVTGMYERRIDLLSI

SEQ ID NO: 1821 - protein, 1366 aa, Unknown; identical to SEQ ID NO: 1777
  Description of Unknown: uncultivated organism with predicted taxonomy: Butyrivibrio sp. CAG:318
  MG23-67 effector

SEQ ID NO: 1822 - protein, 1366 aa, Unknown
  Description of Unknown: uncultivated organism with predicted taxonomy: Butyrivibrio sp. CAG:318
  MG23-68 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEEYLPFLLGKDESGLTVSERIVELFRFHIPYYVGPIGAQGENVWAQRRPGEEKGRVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQILKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKKLDIKKQCYIIGQIISWINSSTQNVNLKDVCGSEHSGMQRLNKKISECKECILIHQSVTGMYERRIDLLSI

SEQ ID NO: 1823 - protein, 1366 aa, Unknown
  Description of Unknown: uncultivated organism with predicted taxonomy: Butyrivibrio sp. CAG:318
  MG23-69 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVVSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1824 - protein, 1368 aa, Unknown
  Description of Unknown: uncultivated organism with predicted taxonomy: Butyrivibrio sp. CAG:318
  MG23-70 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLTGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKNLDIKKQCYIIGQIISWINSSTQNVNLKDVCGSEHSGMQRLNKKISECKECILIHQSVTGMYERRIDLLSI

SEQ ID NO: 1825 - protein, 774 aa, Unknown
  Description of Unknown: uncultivated organism with predicted taxonomy: Butyrivibrio sp. YAB3001
  MG23-71 effector
GNFLNESLSTNSNSVSISDAYQNLVEIANLFDISFPANIDVTKLQDILSDRTTSKRVKLEQLVELMGIVKKASPAEYELLQMCCGMKGKLSNIFGEVISEEDKAFSFSFSDSKYEENAGKALELVGDEYYEIIDAVKEVYDIGLLANIMKGEKYLSDARVADYKAHKKDLALLKQVIREYAEDEYDNFFRKMDEGNYSAYVGSVNSKLEKIRRNGNKGRSQEDLYKTIQTIIKNMREEDKEDSRVKEILSKIEAGSFLPKQLTGSNGVIPNQVHEREMKQILENASTYLPFLREKDESGLSVAERILKMFTFHIPYYIGPLGQEHLDENGYNVWARRIAPGPIYPWNIEEKIDVNEAAEKFITRMLRKCTYIQDEQALPKQSLLYEKFMVLNELNNLRIFGEKISVEVKQNIFNELFMKGKKVTRDNLIKYLVASGVISKNESAEEAISGVDGDFKSYLSSVNKFESIFGKESIYGSKREMIEKIIFWGTVFGKDKRIIKEKLKKEYGSELSDDVIKRIAGFNFSGWGNLSEELLEMPGSCGTDEEEKSIIICLWETNENLMELLGSSHTFKKEIENRIATQNKELMEWTIEDLDGMYLSPSVKRRVWQTLKVLKEIYQVTGGEPEKIFVEMPREEGEKGKRTESRKKKLEFLYKGQKQFLQEIGKRDERDFRQKKLYLYYLQNGKSMYTGNEIDLDELLSNNSKYDIDHIYPRHYIKDDSLDNNLVLVEKEINNDIKGGDYPISKTIQSKMRSFWKELQEKGFITSEKYNRLV

SEQ ID NO: 1826 - protein, 1386 aa, Unknown
  Description of Unknown: uncultivated organism with predicted taxonomy: Eubacterium
  MG23-72 effector
MDRDDKKMYVGIDMGTNSVGLAVTDENYNLYRVKGKDFWCSRIFSKAETAEVRRVNRISRRRRQRETARQGILREFFAEEINKVDEGFFARLDESKYHIEDRENQQKYTLFIDNGYTDKEYYAEYPTIFHLRNELLHPQKDSYDVRLVYLAISNMFKHRGNFLNETLDMGKVTSSAGDIYQQLVEEAMLYVIELPVSIDVERLINIIGEKGVSRSKHLENVSSYLGITKKDKSAYEILKLVCGMSGLLFNIYGEEIIDEENKKFSLNFRDTNYEEKEGKALELLGNDNFQLIEIIKELHDIGVLSSIIKGHKFLSESRVELYEEHKKDLDMLQVVLKRYDKKAYNDMFRIMKEGNYSAYVGSVNSIGQNEKRSEKCQKQKIRRNRGKGSSQEVFYKYVKSVLKKLPEDDKDVKKIMEKIENETFMPKQLTASNGVIPNQLHTVELRAILENAEKYLSFLLNKDESGLTVSQRIVELFKFHIPYYVGPIGASGQNVWAKRRKGEEKGRIYPWNFEQKIDTQAAAEEFIGRMVRHCTYLANERTLPKQSLLYEKYMVLNELNNMKINGIKPDVSVKQGIYDDLFKKGKRVTLNALKSYLYNNSIIESKEDVVITGIDIVHNGGFSASLTSVGKFIGVLGDELFTDENQTMVEQIIFWGTVYGNDKKFLKNRIQETYAGRLTWEQIKRIAGFKFNGWGNLSKAFLELKGNCECGECSIIQALWETNHNLMELLADQYDFKKNLEAMSNNVEKPLQEWTIEDLEGKYLSAPVKRMVWQTMKMLREVCELTGRQPDKVFVEMPREEGIKNERKNSRKKKLLELYTSIKNEQKAWSEVKIREIDGRTETDFRIKKLYLYYLQQGKCMYSGEKIELNDLFNNNLYDIDHIYPRHFIKDDSIENNLVLVKKQINNHKSDTFPIESSIQKNMMTFWKTLVEHNFITKEKYNRLMRTEEFTDEEKAAFISRQLVETRQGTKAITQILKQAFPDTQIIFVKAGVVSDFRKKFNINKVRALNDTHHAKDAYLNIVVGNIYNTKFTSNPINFIKDARKNVNDVSYKYNMDKMFDYNVCRNGENAWIADNGKSKQHVLSVLGKNSVIITRKTEENHGALSNKVTVWSKETAKKNPGAYMPVKTTDSKAQDVTKYGGITSVASSGYTLIEYKVKGKIIRSIEALPVYLGKSDTLTEEKILEYIGESLEKEYKDKKISDIKVRVKFIPLKSKIRLDGFNYYLGGKTGNYIYLNNNEALYLNNNDEEYLRKITKAIDITNYEEIDENGNVIITHEKNTKLFNVLCEKLNNKPYINNRWNIYNVLEGKEEIFRKLDVEKQCYIINQIILWGNSAVQNINLKYINGKEHEGSLLMNKKISEYDEVVLIQQSVTGMYERKTDLLKV

SEQ ID NO: 1827 - protein, 114 aa, Unknown
  Description of Unknown: uncultivated organism with predicted taxonomy: Candidatus Melainabacteria
  MG1-4 RuvC-III domain
AETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDK

SEQ ID NO: 1828 - protein, 142 aa, Unknown
  Description of Unknown: uncultivated organism with predicted taxonomy: Verrucomicrobia
  MG1-5 RuvC-III domain
AETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLAEVVPTKVAIKK

SEQ ID NO: 1829 - protein, 140 aa, Unknown
  Description of Unknown: uncultivated organism with predicted taxonomy: unclassified Verrucomicrobia (miscellaneous)
  MG1-6 RuvC-III domain
AETAHIAKLAQKIVCMHFGFQFGGLSGTKRVFTVPGALTSRIRKFYGLDRILHNAAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1830 - protein, 140 aa, Unknown
  Description of Unknown: uncultivated organism with predicted taxonomy: unclassified Verrucomicrobia (miscellaneous)
  MG1-7 RuvC-III domain
AETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKK

SEQ ID NO: 1831 - protein, 137 aa, Unknown
  Description of Unknown: uncultivated organism
  MG1-1 RuvC-III domain
AETAWISKLAQAIVNLQFGWTNGYDEKRERRVIVVSGGLTARVRRKYGLDKLLYNDVTDLEVLAKKVKNRDDKRHHALDAMVMTFIPQWARNPDQEGFFRFPREFRDASGREDYQKVRQLFAKHLSEVMPTNIAFER

SEQ ID NO: 1832 - protein, 127 aa, Unknown
  Description of Unknown: uncultivated organism with predicted taxonomy: Verrucomicrobia
  MG1-2 RuvC-III domain
AETAWISKLAQTILNLKFGWTNGNTPDGRKAVVVVPGGLTARIRRKYSLNSLLAGDGVDEEEAEKKNRKDHRHHALDAMVISFLPGWVANPDKEHFFRFPEPVRANPRGFFQTAIHNVVPRQLCFEK

SEQ ID NO: 1833 - protein, 137 aa, Unknown
  Description of Unknown: uncultivated organism
  MG1-3 RuvC-III domain
QLARQLRAEIMRWMQVDDKPDEAARRIGTPSGWLAAQARKSWLPAEEYEKVRNNVTHHLIDAAILAHIPPREGMNSVRCKGIFYVESVPVRDPVTGDTTYRLETKALPELSPLPRLKHWLPDNGEYDVCPVWKPRRQ

SEQ ID NO: 1834 - protein, 137 aa, Unknown; identical to SEQ ID NO: 1833
  Description of Unknown: uncultivated organism
  MG1-13 RuvC-III domain

SEQ ID NO: 1835 - protein, 140 aa, Unknown
  Description of Unknown: uncultivated organism
  MG1-8 RuvC-III domain
AETAWISKLAQTIVNLRFGWRNGVDYSGPQPVKRVIVVSGGLTARVRAKYGLDKLLYGENTPPEVLAKKVKNRDDDRHHALDAMVMTFIPHWARDPNKQGFFRFPPAFRDANGREDYQQIQSLFARQLEKIVPRHLAYEP

SEQ ID NO: 1836 - protein, 176 aa, Unknown
  Description of Unknown: uncultivated organism with predicted taxonomy: Verrucomicrobia
  MG1-9 RuvC-III domain
AESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRTKEDFFRFPTAIGDNDFYSKEDQPEMAAIKSQLAKLYVENKPVFR

SEQ ID NO: 1837 - protein, 138 aa, Unknown
  Description of Unknown: uncultivated organism
  MG1-10 RuvC-III domain
QLASQLRKQVAFWLGIHADSDDLSAAVALRERIGNPQGQYTAAMRRSLLPESGKDRSGYVHHREDAALLSCMPPMGLNSIKYKGIFYTKMVPWLDSSGQLQQRRSLFALSCADGLPLPDIASILEDDTECPIIKRRSE

SEQ ID NO: 1838 - protein, 123 aa, Unknown
  Description of Unknown: uncultivated organism
  MG1-11 RuvC-III domain
QLARELRRYIAVWMGINRDVDAVRERIGNPCGSYTAAARRGMLPADYRKDRSNNLHHRIDAAVLTCIPPAAGLNNLRCGGIFRNTRINGKRCTTTIPGLPLPDFGALIADDSTCPLVSRRRTG

SEQ ID NO: 1839 - protein, 125 aa, Unknown
  Description of Unknown: uncultivated organism
  MG1-12 RuvC-III domain
QLARQLREEAARWLGVFGDDAKVRQKIGTPTGYQTSVCREAWSENVPKKDRTNLRHHLWDAAVISHIPPDRGMQLSHCGGIFFHAGEKKNGNILMRALPGLGPDLNSFENATKDQCLVEKKKTNR

SEQ ID NO: 1840 - protein, 137 aa, Unknown; identical to SEQ ID NO: 1831
  Description of Unknown: uncultivated organism
  MG1-14 RuvC-III domain

SEQ ID NO: 1841 - protein, 130 aa, Unknown
  Description of Unknown: uncultivated organism
  MG1-20 RuvC-III domain
AVTGWVARMARDIACLWFGWEPGAEGEQRKLHTVSGSLVGKVRRKFGLNKALNPFLSAADAKKDEKNREDKRHHALDAMVMTYLDEYMRNPRNFSKLQKELGEIFGKLGGAQYFEEKLEDVIPHKIARNK

SEQ ID NO: 1842 - protein, 130 aa, Unknown; identical to SEQ ID NO: 1841
  Description of Unknown: uncultivated organism with predicted taxonomy: Candidatus Peregrinibacteria bacterium CG10_big_fil_rev_8_21_14_0_10_54_7
  MG1-21 RuvC-III domain

SEQ ID NO: 1843 - protein, 130 aa, Unknown; identical to SEQ ID NO: 1841
  Description of Unknown: uncultivated organism with predicted taxonomy: Candidatus Peregrinibacteria bacterium CG10_big_fil_rev_8_21_14_0_10_54_7
  MG1-22 RuvC-III domain

SEQ ID NO: 1844 - protein, 114 aa, Unknown
  Description of Unknown: uncultivated organism with predicted taxonomy: Candidatus Melainabacteria bacterium
  MG1-23 RuvC-III domain
AETAQIARIAQQITALVFNWGLQVEGENRHIFVNNGSSTASIRRTYKLNKLLGDDVKKNRDNDKHHALDAICISFSRDYKYNKEKKVDEIEGLNPEIIKEVINNLMPYPYANDK

SEQ ID NO: 1845 - protein, 114 aa, Unknown
  Description of Unknown: uncultivated organism
  MG1-24 RuvC-III domain
AETAYIARVAQQITAFCFGWGLQVEGEKRHIFVNNGSSTHAIRRRYGLNSLLGNDIKKNRDNDKHHALDAICISFSRDFKYDEKSKVDVIDGFTKEMVKKVLDEIIPYPYTNKK

SEQ ID NO: 1846 - protein, 120 aa, Unknown
  Description of Unknown: uncultivated organism
  MG1-25 RuvC-III domain
AETAQIARVAQDITAFVFGWGLQLEGEKRRIFVNNGATTSAIRKTYRLNKLLGNDVKKNRQNDKHHALDAICISFSRGYKYNATTKRDEIEGLDIHDNEFRDLVKSSIDSLLPYPYSNDK

SEQ ID NO: 1847 - protein, 114 aa, Unknown
  Description of Unknown: uncultivated organism
  MG1-26 RuvC-III domain
AETSHIARVAQQMTAFIFGWGLQVQGKNRRIFVNNGSSTCAIRKRYDLNKLLGDDRKKNRENDKHHALDAICISFSRDFKYDKEIKKDIIKGFNPEIVKDAIDKIMPYPYANDK

SEQ ID NO: 1848 - protein, 120 aa, Unknown
  Description of Unknown: uncultivated organism
  MG1-27 RuvC-III domain
AETAQIARVAQDITAFIFGWGLQLKDEKRRIFVNNGASTSGIRKTYRLNKLLGNDVKKNRNNDKHHALDAICISFSQNYKYNKHTKRDEIEGLDIHDNEFRELIKQTLDAIIPYPYTNDK

SEQ ID NO: 1849 - protein, 114 aa, Unknown
  Description of Unknown: uncultivated organism
  MG1-28 RuvC-III domain
AETAHIAKVAQQIAAVCFSWGLQIEGEKRHIYVNNGSSTHAIRHRYGLNSLLGNDIKKNRDNDKHHALDAICISFSRDFKYDEESKKDIIKGFTREMVKKVIDEIMPVPYTNKK

SEQ ID NO: 1850 - protein, 114 aa, Unknown; identical to SEQ ID NO: 1845
  Description of Unknown: uncultivated organism
  MG1-29 RuvC-III domain

SEQ ID NO: 1851 - protein, 114 aa, Unknown; identical to SEQ ID NO: 1849
  Description of Unknown: uncultivated organism
  MG1-30 RuvC-III domain

SEQ ID NO: 1852 - protein, 120 aa, Unknown
  Description of Unknown: uncultivated organism
  MG1-31 RuvC-III domain
AETAQIARVAQDITAFIFSWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDK

SEQ ID NO: 1853 - protein, 120 aa, Unknown
  Description of Unknown: uncultivated organism
  MG1-32 RuvC-III domain
AETAQIARVAQDITAFIFGWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDK

SEQ ID NO: 1854 - protein, 120 aa, Unknown; identical to SEQ ID NO: 1852
  Description of Unknown: uncultivated organism
  MG1-33 RuvC-III domain

SEQ ID NO: 1855 - protein, 114 aa, Unknown; identical to SEQ ID NO: 1847
  Description of Unknown: uncultivated organism with predicted taxonomy: Candidatus Gastranaerophilales bacterium HUM_9
  MG1-34 RuvC-III domain

SEQ ID NO: 1856 - protein, 120 aa, Unknown; identical to SEQ ID NO: 1846
  Description of Unknown: uncultivated organism
  MG1-35 RuvC-III domain

SEQ ID NO: 1857 - protein, 115 aa, Unknown
  Description of Unknown: uncultivated organism with predicted taxonomy: Clostridium
  MG1-36 RuvC-III domain
EDTQYIAKWITNYIRRNIQFVECSKYNNKVLIISSNLTSYINRKLDISNNIIIGNQKHALDALVTATVSKELLNKIIIYSRENTENSQFPIPWENFKQDMNNLPPIFVSRAPKRK

SEQ ID NO: 1858 - protein, 120 aa, Unknown; identical to SEQ ID NO: 1846
  Description of Unknown: uncultivated organism
  MG1-37 RuvC-III domain

SEQ ID NO: 1859 - protein, 114 aa, Unknown; identical to SEQ ID NO: 1844
  Description of Unknown: uncultivated organism with predicted taxonomy: Candidatus Melainabacteria bacterium
  MG1-38 RuvC-III domain

SEQ ID NO: 1860 - protein, 120 aa, Unknown; identical to SEQ ID NO: 1852
  Description of Unknown: uncultivated organism
  MG1-39 RuvC-III domain

SEQ ID NO: 1861 - protein, 120 aa, Unknown; identical to SEQ ID NO: 1853
  Description of Unknown: uncultivated organism
  MG1-40 RuvC-III domain

SEQ ID NO: 1862 - protein, 114 aa, Unknown; identical to SEQ ID NO: 1847
  Description of Unknown: uncultivated organism with predicted taxonomy: Candidatus Gastranaerophilales bacterium HUM_9
  MG1-41 RuvC-III domain

SEQ ID NO: 1863 - protein, 120 aa, Unknown; identical to SEQ ID NO: 1848
  Description of Unknown: uncultivated organism
  MG1-42 RuvC-III domain

SEQ ID NO: 1864 - protein, 120 aa, Unknown; identical to SEQ ID NO: 1852
  Description of Unknown: uncultivated organism
  MG1-43 RuvC-III domain

SEQ ID NO: 1865 - protein, 114 aa, Unknown; identical to SEQ ID NO: 1849
  Description of Unknown: uncultivated organism
  MG1-44 RuvC-III domain

SEQ ID NO: 1866 - protein, 114 aa, Unknown; identical to SEQ ID NO: 1847
  Description of Unknown: uncultivated organism with predicted taxonomy: Candidatus Melainabacteria
  MG1-45 RuvC-III domain

SEQ ID NO: 1867 - protein, 114 aa, Unknown; identical to SEQ ID NO: 1849
  Description of Unknown: uncultivated organism
  MG1-46 RuvC-III domain

SEQ ID NO: 1868 - protein, 120 aa, Unknown; identical to SEQ ID NO: 1848
  Description of Unknown: uncultivated organism
  MG1-47 RuvC-III domain

SEQ ID NO: 1869 - protein, 114 aa, Unknown
  Description of Unknown: uncultivated organism
  MG1-48 RuvC-III domain
AETAQIARVAQQLAAFIFGWGMQTEGDKRHLFINNGSTTAAIRRRYGLNKLLGDDIKKNRENDKHHALDAICISFSKDFKYDHKSKKDIIEGFTYDFVKNEIDKLIPYPYANDK

SEQ ID NO: 1870 - protein, 114 aa, Unknown
  Description of Unknown: uncultivated organism
  MG1-49 RuvC-III domain
NETTQIAKIVQSVTASVLEWDLQVKDKNRHIFISDGSSTHKIRQQYKLDRLLDDNAKKNRENGKHRALDAICISYSKDFQYNTEQHKYEIENIDIPHIEDVINHVVPYPYTNDK

SEQ ID NO: 1871 - protein, 114 aa, Unknown; identical to SEQ ID NO: 1870
  Description of Unknown: uncultivated organism
  MG1-50 RuvC-III domain

SEQ ID NO: 1872 - protein, 114 aa, Unknown
  Description of Unknown: uncultivated organism with predicted taxonomy: Candidatus Melainabacteria bacterium
  MG1-51 RuvC-III domain
ADTAQIAKVAQQLAAFIFGWGMQTDGDKRHLFVNNGSTTAAIRRRYGLNKILGNDIKKNRENDKHHALDAICISFSQDFKYDPKSQKDIINGFTYDFVKNEIDKLIPYPYANNK

SEQ ID NO: 1873 - protein, 114 aa, Unknown
  Description of Unknown: uncultivated organism
  MG1-52 RuvC-III domain
AETAQIARVAQQLAAFIFGLGMQTEGDKRHLFVNNGSTTAAIRRRYGLNKLLGDDVKKNRENDKHHALDAICISFSRDFKYDEKSKKDVIEGFTYDFVKKAIDELIPYPYANDK

SEQ ID NO: 1874 - protein, 114 aa, Unknown; identical to SEQ ID NO: 1870
  Description of Unknown: uncultivated organism
  MG1-53 RuvC-III domain

SEQ ID NO: 1875 - protein, 114 aa, Unknown; identical to SEQ ID NO: 1870
  Description of Unknown: uncultivated organism
  MG1-54 RuvC-III domain

SEQ ID NO: 1876 - protein, 114 aa, Unknown; identical to SEQ ID NO: 1870
  Description of Unknown: uncultivated organism
  MG1-55 RuvC-III domain

SEQ ID NO: 1877 - protein, 114 aa, Unknown
  Description of Unknown: uncultivated organism
  MG1-56 RuvC-III domain
AETAHIARVAQQITAFIFDWGLQLEGENRHIFVNNGSSTCAIRKRYHLNSLLGDDEKKNRSNDKHHALDAICISYSRDFKYDKNIKKDTIEEFNPEVVKKVIDEIIPYPYANKK

SEQ ID NO: 1878 - protein, 114 aa, Unknown
  Description of Unknown: uncultivated organism
  MG1-57 RuvC-III domain
NETAQIAKVAQSITAFILGWGLQVKGENRHIFVNNGSSTHKIRQQFKLNRLLGNDEKKNRENDKHHALDAICISYSKDFRYNTEKHKYEIDNLDIPHIEEVINSIVPYPYTNDK

SEQ ID NO: 1879 - protein, 114 aa, Unknown
  Description of Unknown: uncultivated organism with predicted taxonomy: Candidatus Termititenax aidoneus
  MG1-58 RuvC-III domain
AETAQIARVAQEITAFVFGWGMQTSGDDRHIFVNNGSSTSAIRRRYGLNKILGDDVKKNRENDKHHALDAICISFSRDFKYDEHSKKDVIKGFTYDFVKKEIDKLMPYPYANDK

SEQ ID NO: 1880 - protein, 141 aa, Unknown
  Description of Unknown: uncultivated organism with predicted taxonomy: Verrucomicrobia
  MG1-59 RuvC-III domain
AETAWISKLAQRICCLHFGFQFGGLTGAKKVWTVSGNTTAMIRGRYGLNRLLHDEESAADSLFDRICMEKKFEEKNRKNKKHHALDAMCLCFAPTSNAKKASAYKNILPEEITRNPESDEARKFFGKYLANVIPNKVAVEK

SEQ ID NO: 1881 - protein, 140 aa, Unknown
  Description of Unknown: uncultivated organism with predicted taxonomy: unclassified Verrucomicrobia (miscellaneous)
  MG1-60 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1882 - protein, 129 aa, Unknown
  Description of Unknown: uncultivated organism
  MG1-61 RuvC-III domain
AETAYIAKMSQKIAHLFFGWSQGTLGSKKKVIVANGSLTAKMRGLYGLNRILHSGISEEEYKELVKSGKIDEKNRDNPRHHALDAIVLSMLPEIQMNDRKKDFFPIWFTPDYCRENLEKCFPKHIKYEK

SEQ ID NO: 1883 - protein, 129 aa, Unknown; identical to SEQ ID NO: 1882
  Description of Unknown: uncultivated organism with predicted taxonomy: Deltaproteobacteria
  MG1-62 RuvC-III domain

SEQ ID NO: 1884 - protein, 176 aa, Unknown
  Description of Unknown: uncultivated organism with predicted taxonomy: Verrucomicrobia bacterium 61-8
  MG1-63 RuvC-III domain
AESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRTKEDFFRFPTAIGDNDFYSKEDQPEMAAIKSELAKLYVENKPVFR

SEQ ID NO: 1885 - protein, 176 aa, Unknown
  Description of Unknown: uncultivated organism
  MG1-64 RuvC-III domain
AESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSELAKLYVENKPVFR

SEQ ID NO: 1886 - protein, 179 aa, Unknown
  Description of Unknown: uncultivated organism with predicted taxonomy: Verrucomicrobia
  MG1-65 RuvC-III domain
ATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEK

SEQ ID NO: 1887 - protein, 129 aa, Unknown
  Description of Unknown: uncultivated organism
  MG1-66 RuvC-III domain
AETSYISRLAQKIVHLYFGWEQLTKGSSRRVFVVSGAFTKRIRDLFKLDAILYPDLTLEEVYKYSAEEREEKNRNNPRHHALDALVVSITQEIKYNPLKGKDEYPEWFTPEFCKQAVERCLPVKVRFEK

SEQ ID NO: 1888 - protein, 176 aa, Unknown
  Description of Unknown: uncultivated organism
  MG1-67 RuvC-III domain
AESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRNKEDFFRFPTAIGDNDLYSKEDQPKIEAIKSKLAKLYEENGAVFR

SEQ ID NO: 1889 - protein, 129 aa, Unknown
  Description of Unknown: uncultivated organism with predicted taxonomy: Elusimicrobia bacterium HGW-Elusimicrobia-1
  MG1-68 RuvC-III domain
AETAYIAKLSQKICHLFFGWEQGTEGSKRKVIVANGGLTAKMRNAYDLNRILHTGLSDAEYKELCKSGEIDKKNRDNPRHHALDAMVISMIPEIKMNDRKKDFFPIWFNPDYCREKLEQCFPKNIRYEK

SEQ ID NO: 1890 - protein, 140 aa, Unknown
  Description of Unknown: uncultivated organism with predicted taxonomy: Pedosphaera sp. Tous-C6FEB
  MG1-69 RuvC-III domain
AETAWISKLAQTIVNLRFGWRNGVDYSGPQPVKRVIVVSGGLTARVRRKYGLDKLLYGEDTAPEVLAKKVKNRDDDRHHALDAMVMTFIPHWARDPNKQGFFRFPPAFRDANGREDYQRIRSLFASHLQQIVPRHLAYEP

SEQ ID NO: 1891 - protein, 123 aa, Unknown
  Description of Unknown: uncultivated organism with predicted taxonomy: Endomicrobium
  MG1-70 RuvC-III domain
AETSYISRLAQRIVHLFFGWEQLTKGSTRHVYVVSGALTKYIRDKFELDVLLYPDLTKEEVFKIPSEEREEKNRNNPRHHALDALVVSIARPENVDKYPEWFTQDFCRMAIEKCLPVKVRFEK

SEQ ID NO: 1892 - protein, 179 aa, Unknown; identical to SEQ ID NO: 1886
  Description of Unknown: uncultivated organism
  MG1-71 RuvC-III domain

SEQ ID NO: 1893 - protein, 105 aa, Unknown
  Description of Unknown: uncultivated organism with predicted taxonomy: Deltaproteobacteria
  MG1-72 RuvC-III domain
AETAWISKLAQTIVNLRFGWRNGVDYSGPQPVKRVIVVSGGLTARVRAKYGLDKLLYGENTPPEVLAKKVKNRDDDRHHALDAMVMTFIPHWARDPHKEGFFRFP

SEQ ID NO: 1894 - protein, 176 aa, Unknown
  Description of Unknown: uncultivated organism with predicted taxonomy: Pedosphaera sp. Tous-C6FEB
  MG1-73 RuvC-III domain
AESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSQLAKLYVENKPVFR

SEQ ID NO: 1895 - protein, 179 aa, Unknown; identical to SEQ ID NO: 1886
  Description of Unknown: uncultivated organism
  MG1-74 RuvC-III domain

SEQ ID NO: 1896 - protein, 83 aa, Unknown
  Description of Unknown: uncultivated organism
  MG1-75 RuvC-III domain
QLARQLVAECAHWMGIAGDPDEIQRRIGTPSGYMRAQALRSWEDTVPAKNRSDLVHHLVDAAVVAHIPPGAGMNQVSYGGIFY

SEQ ID NO: 1897 - protein, 130 aa, Unknown
  Description of Unknown: uncultivated organism
  MG1-76 RuvC-III domain
AETAYISRLAQKICHLFFGWEQLTKGSQRKVFVVSGAFTRKIRTIFELDRILYPDLSDEEYKELLTKGEIQKKNRDNPRHHVLDTIVLSIIPEIKYNPEREKDDYPVWFNKEYCRQYIEKCFPRPIRFVK

SEQ ID NO: 1898 - protein, 123 aa, Unknown
  Description of Unknown: uncultivated organism with predicted taxonomy: Verrucomicrobia
  MG1-78 RuvC-III domain
AETAWISKLAQTIISLRFGWPGGIANGERKIIVVSGGLTGRIRRKYKLNSLLNPDAKSEEEAEVKNRNDDRHHALDAMVISFIPNWARDAKKTGFFRFPDGIHRELFAKEIADVIPLNVCFEK

SEQ ID NO: 1899 - protein, 156 aa, Unknown
  Description of Unknown: uncultivated organism
  MG1-79 RuvC-III domain
QLARHLRAEVIHWLGLDQIQDQKERNKEIARRIGTPTGFQTSVCRESWTPPHVFPQMYRLLCDKKGVPVRDRNGQERWVKDRTNLRHHLWDAAVLSHIPPGVGLNSADCGGIFVHRRDPQNGEWSVSALADLGPDLVAFEKANADRCLVVRLRQRK

SEQ ID NO: 1900 - protein, 123 aa, Unknown; identical to SEQ ID NO: 1898
  Description of Unknown: uncultivated organism with predicted taxonomy: Verrucomicrobia
  MG1-80 RuvC-III domain

SEQ ID NO: 1901 - protein, 169 aa, Unknown
  Description of Unknown: uncultivated organism
  MG1-81 RuvC-III domain
QHTAYIARIVRHVALIRLGWTGDDGRDPTIIKGNKPSSSFQVTNGQLTSRLRQAWGLNHILHPLPEGKRWDDLTDAEKEQMQQKNRGDLRHHALDAMVIACTLPWLAHRTVGATDPETGEHGWWQLDERTRRSLALNPVFPTEGQMRRVAEEWMQKVVVRHHVSRSPHQ

SEQ ID NO: 1902 - protein, 19 aa, Unknown
  Description of Unknown: uncultivated organism
  MG1-82 RuvC-III domain
AETAWISKLAQTIVNLRFG

SEQ ID NO: 1903 - protein, 156 aa, Unknown
  Description of Unknown: uncultivated organism
  MG1-83 RuvC-III domain
QIARYLRVEIIHWLGLDRIKNEMERNKQIAGRIGTPTGFQTSICRESWTPRTVFPQMYRLLHDKKGIPVRDQHGRERWVKDRTNLRHHLWDAAVLSHIPPREGLNSADCGGIFVHRRDQQTGEWRVSALPNLGPDLVAFEKENEGRCLVAHLRQRK

SEQ ID NO: 1904 - protein, 138 aa, Unknown
  Description of Unknown: uncultivated organism with predicted taxonomy: Coraliomargarita sp. CAG:312
  MG1-84 RuvC-III domain
AETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKK

SEQ ID NO: 1905 - protein, 140 aa, Unknown; identical to SEQ ID NO: 1881
  Description of Unknown: uncultivated organism with predicted taxonomy: unclassified Verrucomicrobia (miscellaneous)
  MG1-85 RuvC-III domain

SEQ ID NO: 1906 - protein, 138 aa, Unknown; identical to SEQ ID NO: 1904
  Description of Unknown: uncultivated organism with predicted taxonomy: Coraliomargarita sp. CAG:312
  MG1-86 RuvC-III domain

SEQ ID NO: 1907 - protein, 142 aa, Unknown
  Description of Unknown: uncultivated organism with predicted taxonomy: Verrucomicrobia
  MG1-87 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVKK

SEQ ID NO: 1908 - protein, 140 aa, Unknown
  Description of Unknown: uncultivated organism with predicted taxonomy: unclassified Verrucomicrobia (miscellaneous)
  MG1-88 RuvC-III domain
AETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1909 - protein, 140 aa, Unknown; identical to SEQ ID NO: 1881
  Description of Unknown: uncultivated organism with predicted taxonomy: unclassified Verrucomicrobia (miscellaneous)
  MG1-89 RuvC-III domain

SEQ ID NO: 1910 - protein, 140 aa, Unknown; identical to SEQ ID NO: 1881
  Description of Unknown: uncultivated organism with predicted taxonomy: unclassified Verrucomicrobia (miscellaneous)
  MG1-90 RuvC-III domain

SEQ ID NO: 1911 - protein, 142 aa, Unknown
  Description of Unknown: uncultivated organism
  MG1-91 RuvC-III domain
AETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEK

SEQ ID NO: 1912 - protein, 140 aa, Unknown
  Description of Unknown: uncultivated organism with predicted taxonomy: unclassified Verrucomicrobia (miscellaneous)
  MG1-92 RuvC-III domain
AETAHISKLAQKIVCLHFGFQFGGLSGTKRVFTVPGSLTARIRTFYGLNKILHNEDLAHETLSYEGFLKRGEELDKKNRANKKHHALDAMCLCFAPTGVNSKRARVDMLLPPKIRSEKDAELFFRKYLDKLIPVDVAPKK

SEQ ID NO: 1913 - protein, 140 aa, Unknown; identical to SEQ ID NO: 1881
  Description of Unknown: uncultivated organism with predicted taxonomy: unclassified Verrucomicrobia (miscellaneous)
  MG1-93 RuvC-III domain

SEQ ID NO: 1914 - protein, 142 aa, Unknown
  Description of Unknown: uncultivated organism with predicted taxonomy: unclassified Verrucomicrobia (miscellaneous)
  MG1-94 RuvC-III domain
AETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLEEVVPTKVAIKK

SEQ ID NO: 1915 - protein, 138 aa, Unknown; identical to SEQ ID NO: 1904
  Description of Unknown: uncultivated organism with predicted taxonomy: Coraliomargarita sp. CAG:312
  MG1-95 RuvC-III domain

SEQ ID NO: 1916 - protein, 140 aa, Unknown; identical to SEQ ID NO: 1908
  Description of Unknown: uncultivated organism with predicted taxonomy: unclassified Verrucomicrobia (miscellaneous)
  MG1-96 RuvC-III domain

SEQ ID NO: 1917 - protein, 140 aa, Unknown; identical to SEQ ID NO: 1881
  Description of Unknown: uncultivated organism with predicted taxonomy: unclassified Verrucomicrobia (miscellaneous)
  MG1-97 RuvC-III domain

SEQ ID NO: 1918 - protein, 140 aa, Unknown; identical to SEQ ID NO: 1881
  Description of Unknown: uncultivated organism with predicted taxonomy: unclassified Verrucomicrobia (miscellaneous)
  MG1-98 RuvC-III domain

SEQ ID NO: 1919 - protein, 140 aa, Unknown; identical to SEQ ID NO: 1881
  Description of Unknown: uncultivated organism with predicted taxonomy: unclassified Verrucomicrobia (miscellaneous)
  MG1-99 RuvC-III domain

SEQ ID NO: 1920 - protein, 138 aa, Unknown; identical to SEQ ID NO: 1904
  Description of Unknown: uncultivated organism with predicted taxonomy: Coraliomargarita sp. CAG:312
  MG1-100 RuvC-III domain

SEQ ID NO: 1921 - protein, 138 aa, Unknown
  Description of Unknown: uncultivated organism with predicted taxonomy: unclassified Verrucomicrobia (miscellaneous)
  MG1-101 RuvC-III domain
AETAWISKLAQQVVCLHFGFQFGGMEGQRRVFCIPGGVTARIRGMFGLNELLHVKDYDTDSMSETEIVELHKRLEKKNRENKKHHALDAMCLCFAPTGSQIKRFDAKTIMPEGILGREKQYFKSYLDKIVPNEVATQK

SEQ ID NO: 1922 - protein, 140 aa, Unknown; identical to SEQ ID NO: 1881
  Description of Unknown: uncultivated organism with predicted taxonomy: unclassified Verrucomicrobia (miscellaneous)
  MG1-102 RuvC-III domain

SEQ ID NO: 1923 - protein, 140 aa, Unknown
  Description of Unknown: uncultivated organism with predicted taxonomy: Verrucomicrobia
  MG1-103 RuvC-III domain
AETAHIAKLAQKIVCMHFGFQFGGLSGTKRVFTLPGALTSRIRKFYGLDRILHISAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1924 - protein, 138 aa, Unknown; identical to SEQ ID NO: 1904
  Description of Unknown: uncultivated organism with predicted taxonomy: Verrucomicrobia
  MG1-104 RuvC-III domain

SEQ ID NO: 1925 - protein, 140 aa, Unknown
  Description of Unknown: uncultivated organism
  MG1-105 RuvC-III domain
AETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKK

SEQ ID NO: 1926 - protein, 142 aa, Unknown
  Description of Unknown: uncultivated organism with predicted taxonomy: Verrucomicrobia
  MG1-106 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLATVIPNKVAVEK

SEQ ID NO: 1927 - protein, 142 aa, Unknown; identical to SEQ ID NO: 1907
  Description of Unknown: uncultivated organism with predicted taxonomy: Verrucomicrobia
  MG1-107 RuvC-III domain

SEQ ID NO: 1928 - protein, 142 aa, Unknown
  Description of Unknown: uncultivated organism with predicted taxonomy: Verrucomicrobia
  MG1-108 RuvC-III domain
AETAWISKLAQRICCLHFGFQFGGLAGAKKVWTVSGNTTAMIRGRYGLNRLLHDEEAAEDLSLFDRICMEKKFEEKNRKNKKHHALDAMCLCFAPTSNAKKASAYKNILPEEITRNPESDEARKFFGRYLATVIPNKVAVEK

SEQ ID NO: 1929 - protein, 140 aa, Unknown; identical to SEQ ID NO: 1881
  Description of Unknown: uncultivated organism with predicted taxonomy: unclassified Verrucomicrobia (miscellaneous)
  MG1-109 RuvC-III domain

SEQ ID NO: 1930 - protein, 142 aa, Unknown
  Description of Unknown: uncultivated organism with predicted taxonomy: Verrucomicrobia
  MG1-110 RuvC-III domain
AETAWISKLAQRICCLHFGFQFGGLAGAKKVWTVSGNTTAMIRGRYGLNRLLHDEESAEDLSLFDRICMEKKLEEKNRKNKKHHALDAMCLCFAPTSNAKKASAYKNILPEEITRNPESDEARKFFGKYLANVIPNKVAVEK

SEQ ID NO: 1931 - protein, 138 aa, Unknown; identical to SEQ ID NO: 1904
  Description of Unknown: uncultivated organism with predicted taxonomy: Coraliomargarita sp. CAG:312
  MG1-111 RuvC-III domain

SEQ ID NO: 1932 - protein, 140 aa, Unknown; identical to SEQ ID NO: 1881
  Description of Unknown: uncultivated organism with predicted taxonomy: unclassified Verrucomicrobia (miscellaneous)
  MG1-112 RuvC-III domain

SEQ ID NO: 1933 - protein, 140 aa, Unknown
  Description of Unknown: uncultivated organism with predicted taxonomy: Verrucomicrobia
  MG1-113 RuvC-III domain
AETAHISKLAQKIVCLHFGFQFGGLGGTKRVFTVPGALTARIRSFYGLNKILHNEDLAKDALSYEEVLKRGEELDKKNRENEKHHALDAMCLCFAPTGVNSKRARIDMLLPPDIRGEGKAELFFRKYLDRLIPVDVAPKK

SEQ ID NO: 1934 - protein, 140 aa, Unknown; identical to SEQ ID NO: 1912
  Description of Unknown: uncultivated organism with predicted taxonomy: unclassified Verrucomicrobia (miscellaneous)
  MG1-114 RuvC-III domain

SEQ ID NO: 1935 - protein, 140 aa, Unknown; identical to SEQ ID NO: 1830
  Description of Unknown: uncultivated organism with predicted taxonomy: unclassified Verrucomicrobia (miscellaneous)
  MG1-115 RuvC-III domain

SEQ ID NO: 1936 - protein, 142 aa, Unknown
  Description of Unknown: uncultivated organism with predicted taxonomy: Verrucomicrobia
  MG1-116 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGRYLATVIPNKVAVEK

SEQ ID NO: 1937 - protein, 138 aa, Unknown; identical to SEQ ID NO: 1904
  Description of Unknown: uncultivated organism with predicted taxonomy: Coraliomargarita sp. CAG:312
  MG1-117 RuvC-III domain

SEQ ID NO: 1938 - protein, 140 aa, Unknown; identical to SEQ ID NO: 1881
  Description of Unknown: uncultivated organism with predicted taxonomy: unclassified Verrucomicrobia (miscellaneous)
  MG1-118 RuvC-III domain

SEQ ID NO: 1939 - protein, 140 aa, Unknown; identical to SEQ ID NO: 1881
  Description of Unknown: uncultivated organism with predicted taxonomy: unclassified Verrucomicrobia (miscellaneous)
  MG1-119 RuvC-III domain

SEQ ID NO: 1940 - protein, 140 aa, Unknown
  Description of Unknown: uncultivated organism with predicted taxonomy: unclassified Verrucomicrobia (miscellaneous)
  MG1-120 RuvC-III domain
AETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKK

SEQ ID NO: 1941 - protein, 140 aa, Unknown; identical to SEQ ID NO: 1881
  Description of Unknown: uncultivated organism with predicted taxonomy: unclassified Verrucomicrobia (miscellaneous)
  MG1-121 RuvC-III domain

SEQ ID NO: 1942 - protein, 140 aa, Unknown; identical to SEQ ID NO: 1908
  Description of Unknown: uncultivated organism with predicted taxonomy: unclassified Verrucomicrobia (miscellaneous)
  MG1-122 RuvC-III domain

SEQ ID NO: 1943 - protein, 140 aa, Unknown
  Description of Unknown: uncultivated organism with predicted taxonomy: unclassified Verrucomicrobia (miscellaneous)
  MG1-123 RuvC-III domain
AETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRAKLGEILPEKLRSEKAAREFFKSYLDKIMPVDVAPKK

SEQ ID NO: 1944 - protein, 142 aa, Unknown
  Description of Unknown: uncultivated organism with predicted taxonomy: Verrucomicrobia
  MG1-124 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEK

SEQ ID NO: 1945 - protein, 138 aa, Unknown; identical to SEQ ID NO: 1904
  Description of Unknown: uncultivated organism with predicted taxonomy: Verrucomicrobia
  MG1-125 RuvC-III domain

SEQ ID NO: 1946 - protein, 140 aa, Unknown; identical to SEQ ID NO: 1881
  Description of Unknown: uncultivated organism with predicted taxonomy: unclassified Verrucomicrobia (miscellaneous)
  MG1-126 RuvC-III domain

SEQ ID NO: 1947 - protein, 142 aa, Unknown; identical to SEQ ID NO: 1926
  Description of Unknown: uncultivated organism with predicted taxonomy: Verrucomicrobia
  MG1-127 RuvC-III domain

SEQ ID NO: 1948 - protein, 140 aa, Unknown; identical to SEQ ID NO: 1908
  Description of Unknown: uncultivated organism with predicted taxonomy: unclassified Verrucomicrobia (miscellaneous)
  MG1-128 RuvC-III domain

SEQ ID NO: 1949 - protein, 142 aa, Unknown
  Description of Unknown: uncultivated organism with predicted taxonomy: Verrucomicrobia
  MG1-129 RuvC-III domain
AETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEK

SEQ ID NO: 1950 - protein, 140 aa, Unknown; identical to SEQ ID NO: 1881
  Description of Unknown: uncultivated organism with predicted taxonomy: unclassified Verrucomicrobia (miscellaneous)
  MG1-130 RuvC-III domain

SEQ ID NO: 1951 - protein, 140 aa, Unknown; identical to SEQ ID NO: 1912
  Description of Unknown: uncultivated organism with predicted taxonomy: unclassified Verrucomicrobia (miscellaneous)
  MG1-131 RuvC-III domain

SEQ ID NO: 1952 - protein, 140 aa, Unknown; identical to SEQ ID NO: 1881
  Description of Unknown: uncultivated organism with predicted taxonomy: unclassified Verrucomicrobia (miscellaneous)
  MG1-132 RuvC-III domain

SEQ ID NO: 1953 - protein, 138 aa, Unknown; identical to SEQ ID NO: 1904
  Description of Unknown: uncultivated organism with predicted taxonomy: Coraliomargarita sp. CAG:312
  MG1-133 RuvC-III domain

SEQ ID NO: 1954 - protein, 140 aa, Unknown; identical to SEQ ID NO: 1830
  Description of Unknown: uncultivated organism with predicted taxonomy: unclassified Verrucomicrobia (miscellaneous)
  MG1-134 RuvC-III domain

SEQ ID NO: 1955 - protein, 140 aa, Unknown
  Description of Unknown: uncultivated organism with predicted taxonomy: unclassified Verrucomicrobia (miscellaneous)
  MG1-135 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSGRAKLGEILPEKLRSEKAAREFFKSYLDKIMPVDVAPKK

SEQ ID NO: 1956 - protein, 142 aa, Unknown; identical to SEQ ID NO: 1907
  Description of Unknown: uncultivated organism with predicted taxonomy: Verrucomicrobia
  MG1-136 RuvC-III domain

SEQ ID NO: 1957 - protein, 140 aa, Unknown; identical to SEQ ID NO: 1881
  Description of Unknown: uncultivated organism with predicted taxonomy: unclassified Verrucomicrobia (miscellaneous)
  MG1-137 RuvC-III domain

SEQ ID NO: 1958 - protein, 140 aa, Unknown; identical to SEQ ID NO: 1881
  Description of Unknown: uncultivated organism with predicted taxonomy: unclassified Verrucomicrobia (miscellaneous)
  MG1-138 RuvC-III domain

SEQ ID NO: 1959 - protein, 140 aa, Unknown; identical to SEQ ID NO: 1881
  Description of Unknown: uncultivated organism with predicted taxonomy: unclassified Verrucomicrobia (miscellaneous)
  MG1-139 RuvC-III domain

SEQ ID NO: 1960 - protein, 140 aa, Unknown; identical to SEQ ID NO: 1881
  Description of Unknown: uncultivated organism with predicted taxonomy: unclassified Verrucomicrobia (miscellaneous)
  MG1-140 RuvC-III domain

SEQ ID NO: 1961 - protein, 142 aa, Unknown
  Description of Unknown: uncultivated organism with predicted taxonomy: Verrucomicrobia
  MG1-141 RuvC-III domain
AETAWISKLAQRICCLHFGFQFGGLAGAKKVWTVSGNTTSMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEK

SEQ ID NO: 1962 - protein, 140 aa, Unknown; identical to SEQ ID NO: 1830
  Description of Unknown: uncultivated organism with predicted taxonomy: unclassified Verrucomicrobia (miscellaneous)
  MG1-142 RuvC-III domain

SEQ ID NO: 1963 - protein, 140 aa, Unknown
  Description of Unknown: uncultivated organism with predicted taxonomy: Verrucomicrobia bacterium
  MG1-143 RuvC-III domain
AETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGERKAELFFRKYLDRLIPVDVAPKK

SEQ ID NO: 1964 - protein, 140 aa, Unknown
  Description of Unknown: uncultivated organism with predicted taxonomy: unclassified Verrucomicrobia (miscellaneous)
  MG1-144 RuvC-III domain
AETAHISKLAQKIVCLHFGFQFGGLSGTKRVFTVPGSLTARIRTFYGLNKILHNEDLAHETLSYEGFLKRVEELDKKNRANKKHHALDAMCLCFAPTGVNSKRARVDMLLPPKIRSEKDAELFFRKYLDKLIPVDVAPKK

SEQ ID NO: 1965 - protein, 142 aa, Unknown; identical to SEQ ID NO: 1926
  Description of Unknown: uncultivated organism with predicted taxonomy: Verrucomicrobia
  MG1-145 RuvC-III domain

SEQ ID NO: 1966 - protein, 140 aa, Unknown; identical to SEQ ID NO: 1881
  Description of Unknown: uncultivated organism with predicted taxonomy: unclassified Verrucomicrobia (miscellaneous)
  MG1-147 RuvC-III domain

SEQ ID NO: 1967 - protein, 140 aa, Unknown; identical to SEQ ID NO: 1908
  Description of Unknown: uncultivated organism with predicted taxonomy: unclassified Verrucomicrobia (miscellaneous)
  MG1-148 RuvC-III domain

SEQ ID NO: 1968 - protein, 140 aa, Unknown; identical to SEQ ID NO: 1881
  Description of Unknown: uncultivated organism with predicted taxonomy: unclassified Verrucomicrobia (miscellaneous)
  MG1-149 RuvC-III domain

SEQ ID NO: 1969 - protein, 138 aa, Unknown; identical to SEQ ID NO: 1904
  Description of Unknown: uncultivated organism with predicted taxonomy: Coraliomargarita sp. CAG:312
  MG1-150 RuvC-III domain

SEQ ID NO: 1970 - protein, 140 aa, Unknown
  Description of Unknown: uncultivated organism with predicted taxonomy: Verrucomicrobia
  MG1-151 RuvC-III domain
AETAHISKLAQKIVCLHFGFQFGGLGGTKRVFTVTGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKK

SEQ ID NO: 1971 - protein, 142 aa, Unknown; identical to SEQ ID NO: 1911
  Description of Unknown: uncultivated organism
  MG1-152 RuvC-III domain

SEQ ID NO: 1972 - protein, 140 aa, Unknown
  Description of Unknown: uncultivated organism with predicted taxonomy: unclassified Verrucomicrobia (miscellaneous)
  MG1-153 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPMDVAPKK

SEQ ID NO: 1973 - protein, 142 aa, Unknown; identical to SEQ ID NO: 1949
  Description of Unknown: uncultivated organism with predicted taxonomy: Verrucomicrobia
  MG1-154 RuvC-III domain

SEQ ID NO: 1974 - protein, 142 aa, Unknown
  Description of Unknown: uncultivated organism with predicted taxonomy: Verrucomicrobia
  MG1-155 RuvC-III domain
AETAWISKLAQRVCCIHFGFQFGGLTGVKKVWTVSGNTTAMIRSRYGLNRLLHDENVPKDISLSERLKLENDFEKKNRDNKKHHALDAMCLCYAPTSNTRRAASYKNILPAEITRNPESDEARRFFGRYLANVIPNKVAIEK

SEQ ID NO: 1975 - protein, 138 aa, Unknown; identical to SEQ ID NO: 1904
  Description of Unknown: uncultivated organism with predicted taxonomy: Coraliomargarita sp. CAG:312
  MG1-156 RuvC-III domain

SEQ ID NO: 1976 - protein, 138 aa, Unknown
  Description of Unknown: uncultivated organism with predicted taxonomy: Verrucomicrobia
  MG1-157 RuvC-III domain
AETAWISKLAQQVVCLHFGFQFGGMEGQRRVFCIPGGVTARIRGMFGLNELLHVKDYDTDSMSETEIVELYKRLEKKNRENKKHHALDAMCLCFAPTGSQIKRFDAKTIMPEGILGREKQYFKSYLDKIVPNEVATQK

SEQ ID NO: 1977 - protein, 140 aa, Unknown; identical to SEQ ID NO: 1830
  Description of Unknown: uncultivated organism with predicted taxonomy: unclassified Verrucomicrobia (miscellaneous)
  MG1-158 RuvC-III domain

SEQ ID NO: 1978 - protein, 136 aa, Unknown
  Description of Unknown: uncultivated organism with predicted taxonomy: Coraliomargarita sp. CAG:312
  MG1-159 RuvC-III domain
AETAWIARLAQRIVCMHFGFPMGALIGKKRVFTVSGSVTSRIRGMYGLNKILHNTEIDKTLSEVDILKLNDSLETKNRANKKHHALDAMCLCFAPTSKEVLNKNREILPVEIAKDAENYFRRYLDNIIPNKVATMK

SEQ ID NO: 1979 - protein, 140 aa, Unknown; identical to SEQ ID NO: 1925
  Description of Unknown: uncultivated organism with predicted taxonomy: unclassified Verrucomicrobia (miscellaneous)
  MG1-160 RuvC-III domain

SEQ ID NO: 1980 - protein, 142 aa, Unknown; identical to SEQ ID NO: 1911
  Description of Unknown: uncultivated organism with predicted taxonomy: Verrucomicrobia
  MG1-161 RuvC-III domain

SEQ ID NO: 1981 - protein, 138 aa, Unknown; identical to SEQ ID NO: 1904
  Description of Unknown: uncultivated organism with predicted taxonomy: Coraliomargarita sp. CAG:312
  MG1-162 RuvC-III domain

SEQ ID NO: 1982 - protein, 140 aa, Unknown
  Description of Unknown: uncultivated organism with predicted taxonomy: unclassified Verrucomicrobia (miscellaneous)
  MG1-163 RuvC-III domain
AETAHISKLAQKIVCLHFGFQFGGLSGTKRVFTVPGSLTARIRTFYGLNKILHNEDLAHETLSFEGFLKRGEELDKKNRANKKHHALDAMCLCFAPTGVNSKRARVDMLLPPKIRSEKDAELFFRKYLDKLIPVDVAPKK

SEQ ID NO: 1983 - protein, 142 aa, Unknown
  Description of Unknown: uncultivated organism with predicted taxonomy: Verrucomicrobia
  MG1-164 RuvC-III domain
AETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARKFFAKYLAEVVPTKVAIKK

SEQ ID NO: 1984 - protein, 140 aa, Unknown; identical to SEQ ID NO: 1881
  Description of Unknown: uncultivated organism with predicted taxonomy: unclassified Verrucomicrobia (miscellaneous)
  MG1-165 RuvC-III domain

SEQ ID NO: 1985 - protein, 140 aa, Unknown
  Description of Unknown: uncultivated organism with predicted taxonomy: unclassified Verrucomicrobia (miscellaneous)
  MG1-166 RuvC-III domain
AETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLEKIMPVDVAPKK

SEQ ID NO: 1986 - protein, 140 aa, Unknown; identical to SEQ ID NO: 1881
  Description of Unknown: uncultivated organism with predicted taxonomy: unclassified Verrucomicrobia (miscellaneous)
  MG1-167 RuvC-III domain

SEQ ID NO: 1987 - protein, 142 aa, Unknown; identical to SEQ ID NO: 1911
  Description of Unknown: uncultivated organism with predicted taxonomy: Verrucomicrobia
  MG1-168 RuvC-III domain

SEQ ID NO: 1988 - protein, 140 aa, Unknown; identical to SEQ ID NO: 1881
  Description of Unknown: uncultivated organism with predicted taxonomy: unclassified Verrucomicrobia (miscellaneous)
  MG1-169 RuvC-III domain

SEQ ID NO: 1989 - protein, 140 aa, Unknown; identical to SEQ ID NO: 1881
  Description of Unknown: uncultivated organism with predicted taxonomy: unclassified Verrucomicrobia (miscellaneous)
  MG1-170 RuvC-III domain

SEQ ID NO: 1990 - protein, 140 aa, Unknown; identical to SEQ ID NO: 1881
  Description of Unknown: uncultivated organism with predicted taxonomy: unclassified Verrucomicrobia (miscellaneous)
  MG1-171 RuvC-III domain

SEQ ID NO: 1991 - protein, 142 aa, Unknown; identical to SEQ ID NO: 1907
  Description of Unknown: uncultivated organism with predicted taxonomy: Verrucomicrobia
  MG1-172 RuvC-III domain

SEQ ID NO: 1992 - protein, 140 aa, Unknown; identical to SEQ ID NO: 1881
  Description of Unknown: uncultivated organism with predicted taxonomy: unclassified Verrucomicrobia (miscellaneous)
  MG1-173 RuvC-III domain

SEQ ID NO: 1993 - protein, 140 aa, Unknown; identical to SEQ ID NO: 1881
  Description of Unknown: uncultivated organism with predicted taxonomy: unclassified Verrucomicrobia (miscellaneous)
  MG1-174 RuvC-III domain

SEQ ID NO: 1994 - protein, 142 aa, Unknown; identical to SEQ ID NO: 1944
  Description of Unknown: uncultivated organism with predicted taxonomy: Coraliomargarita sp. CAG:312
  MG1-175 RuvC-III domain

SEQ ID NO: 1995 - protein, 140 aa, Unknown; identical to SEQ ID NO: 1881
  Description of Unknown: uncultivated organism with predicted taxonomy: unclassified Verrucomicrobia (miscellaneous)
  MG1-176 RuvC-III domain

SEQ ID NO: 1996 - protein, 142 aa, Unknown; identical to SEQ ID NO: 1926
  Description of Unknown: uncultivated organism with predicted taxonomy: Verrucomicrobia
  MG1-177 RuvC-III domain

SEQ ID NO: 1997 - protein, 136 aa, Unknown; identical to SEQ ID NO: 1978
  Description of Unknown: uncultivated organism with predicted taxonomy: Coraliomargarita sp. CAG:312
  MG1-178 RuvC-III domain

SEQ ID NO: 1998 - protein, 142 aa, Unknown; identical to SEQ ID NO: 1961
  Description of Unknown: uncultivated organism with predicted taxonomy: Coraliomargarita sp. CAG:312
  MG1-179 RuvC-III domain

SEQ ID NO: 1999 - protein, 140 aa, Unknown
  Description of Unknown: uncultivated organism with predicted taxonomy: unclassified Verrucomicrobia (miscellaneous)
  MG1-180 RuvC-III domain
AETAHIAKLAQKIVCMHFGFQFGGVSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2000 - protein, 140 aa, Unknown; identical to SEQ ID NO: 1912
  Description of Unknown: uncultivated organism with predicted taxonomy: unclassified Verrucomicrobia (miscellaneous)
  MG1-181 RuvC-III domain

SEQ ID NO: 2001 - protein, 140 aa, Unknown; identical to SEQ ID NO: 1830
  Description of Unknown: uncultivated organism with predicted taxonomy: unclassified Verrucomicrobia (miscellaneous)
  MG1-182 RuvC-III domain

SEQ ID NO: 2002 - protein, 138 aa, Unknown; identical to SEQ ID NO: 1904
  Description of Unknown: uncultivated organism with predicted taxonomy: Coraliomargarita sp. CAG:312
  MG1-183 RuvC-III domain

SEQ ID NO: 2003 - protein, 140 aa, Unknown; identical to SEQ ID NO: 1881
  Description of Unknown: uncultivated organism with predicted taxonomy: unclassified Verrucomicrobia (miscellaneous)
  MG1-184 RuvC-III domain

SEQ ID NO: 2004 - protein, 138 aa, Unknown; identical to SEQ ID NO: 1904
  Description of Unknown: uncultivated organism with predicted taxonomy: Coraliomargarita sp. CAG:312
  MG1-185 RuvC-III domain

SEQ ID NO: 2005 - protein, 140 aa, Unknown; identical to SEQ ID NO: 1881
  Description of Unknown: uncultivated organism with predicted taxonomy: unclassified Verrucomicrobia (miscellaneous)
  MG1-186 RuvC-III domain

SEQ ID NO: 2006 - protein, 142 aa, Unknown
  Description of Unknown: uncultivated organism with predicted taxonomy: Verrucomicrobia
  MG1-187 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEK

SEQ ID NO: 2007 - protein, 138 aa, Unknown; identical to SEQ ID NO: 1904
  Description of Unknown: uncultivated organism with predicted taxonomy: Verrucomicrobia
  MG1-188 RuvC-III domain

SEQ ID NO: 2008 - protein, 142 aa, Unknown; identical to SEQ ID NO: 1936
  Description of Unknown: uncultivated organism with predicted taxonomy: Verrucomicrobia
  MG1-189 RuvC-III domain

SEQ ID NO: 2009 - protein, 140 aa, Unknown; identical to SEQ ID NO: 1881
  Description of Unknown: uncultivated organism with predicted taxonomy: unclassified Verrucomicrobia (miscellaneous)
  MG1-190 RuvC-III domain

SEQ ID NO: 2010 - protein, 140 aa, Unknown; identical to SEQ ID NO: 1881
  Description of Unknown: uncultivated organism with predicted taxonomy: unclassified Verrucomicrobia (miscellaneous)
  MG1-191 RuvC-III domain

SEQ ID NO: 2011 - protein, 140 aa, Unknown; identical to SEQ ID NO: 1881
  Description of Unknown: uncultivated organism with predicted taxonomy: unclassified Verrucomicrobia (miscellaneous)
  MG1-192 RuvC-III domain

SEQ ID NO: 2012 - protein, 142 aa, Unknown; identical to SEQ ID NO: 1949
  Description of Unknown: uncultivated organism with predicted taxonomy: Verrucomicrobia
  MG1-193 RuvC-III domain

SEQ ID NO: 2013 - protein, 140 aa, Unknown; identical to SEQ ID NO: 1881
  Description of Unknown: uncultivated organism with predicted taxonomy: unclassified Verrucomicrobia (miscellaneous)
  MG1-194 RuvC-III domain

SEQ ID NO: 2014 - protein, 140 aa, Unknown; identical to SEQ ID NO: 1908
  Description of Unknown: uncultivated organism with predicted taxonomy: unclassified Verrucomicrobia (miscellaneous)
  MG1-195 RuvC-III domain

SEQ ID NO: 2015 - protein, 140 aa, Unknown; identical to SEQ ID NO: 1940
  Description of Unknown: uncultivated organism with predicted taxonomy: Verrucomicrobia
  MG1-196 RuvC-III domain

SEQ ID NO: 2016 - protein, 140 aa, Unknown; identical to SEQ ID NO: 1881
  Description of Unknown: uncultivated organism with predicted taxonomy: unclassified Verrucomicrobia (miscellaneous)
  MG1-197 RuvC-III domain

SEQ ID NO: 2017 - protein, 140 aa, Unknown; identical to SEQ ID NO: 1881
  Description of Unknown: uncultivated organism with predicted taxonomy: unclassified Verrucomicrobia (miscellaneous)
  MG1-198 RuvC-III domain

SEQ ID NO: 2018 - protein, 140 aa, Unknown; identical to SEQ ID NO: 1881
  Description of Unknown: uncultivated organism with predicted taxonomy: unclassified Verrucomicrobia (miscellaneous)
  MG1-199 RuvC-III domain

SEQ ID NO: 2019 - protein, 142 aa, Unknown; identical to SEQ ID NO: 1949
  Description of Unknown: uncultivated organism
  MG1-200 RuvC-III domain

SEQ ID NO: 2020 - protein, 142 aa, Unknown; identical to SEQ ID NO: 1944
  Description of Unknown: uncultivated organism with predicted taxonomy: Verrucomicrobia
  MG1-201 RuvC-III domain

SEQ ID NO: 2021 - protein, 142 aa, Unknown; identical to SEQ ID NO: 2006
  Description of Unknown: uncultivated organism with predicted taxonomy: Coraliomargarita sp. CAG:312
  MG1-202 RuvC-III domain

SEQ ID NO: 2022 - protein, 138 aa, Unknown; identical to SEQ ID NO: 1904
  Description of Unknown: uncultivated organism with predicted taxonomy: Coraliomargarita sp. CAG:312
  MG1-203 RuvC-III domain

SEQ ID NO: 2023 - protein, 142 aa, Unknown; identical to SEQ ID NO: 1930
  Description of Unknown: uncultivated organism with predicted taxonomy: Verrucomicrobia
  MG1-204 RuvC-III domain

SEQ ID NO: 2024 - protein, 142 aa, Unknown; identical to SEQ ID NO: 1944
  Description of Unknown: uncultivated organism with predicted taxonomy: Coraliomargarita sp. CAG:312
  MG1-205 RuvC-III domain

SEQ ID NO: 2025 - protein, 138 aa, Unknown; identical to SEQ ID NO: 1904
  Description of Unknown: uncultivated organism with predicted taxonomy: Coraliomargarita sp. CAG:312
  MG1-206 RuvC-III domain

SEQ ID NO: 2026 - protein, 140 aa, Unknown; identical to SEQ ID NO: 1940
  Description of Unknown: uncultivated organism with predicted taxonomy: unclassified Verrucomicrobia (miscellaneous)
  MG1-207 RuvC-III domain

SEQ ID NO: 2027 - protein, 140 aa, Unknown; identical to SEQ ID NO: 1881
  Description of Unknown: uncultivated organism with predicted taxonomy: unclassified Verrucomicrobia (miscellaneous)
  MG1-208 RuvC-III domain

SEQ ID NO: 2028 - protein, 140 aa, Unknown; identical to SEQ ID NO: 1881
  Description of Unknown: uncultivated organism with predicted taxonomy: unclassified Verrucomicrobia (miscellaneous)
  MG1-209 RuvC-III domain

SEQ ID NO: 2029 - protein, 140 aa, Unknown; identical to SEQ ID NO: 1881
  Description of Unknown: uncultivated organism with predicted taxonomy: unclassified Verrucomicrobia (miscellaneous)
  MG1-210 RuvC-III domain

SEQ ID NO: 2030 - protein, 138 aa, Unknown; identical to SEQ ID NO: 1904
  Description of Unknown: uncultivated organism with predicted taxonomy: Coraliomargarita sp. CAG:312
  MG1-211 RuvC-III domain

SEQ ID NO: 2031 - protein, 140 aa, Unknown; identical to SEQ ID NO: 1908
  Description of Unknown: uncultivated organism with predicted taxonomy: unclassified Verrucomicrobia (miscellaneous)
  MG1-212 RuvC-III domain

SEQ ID NO: 2032 - protein, 115 aa, Unknown
  Description of Unknown: uncultivated organism with predicted taxonomy: unclassified Verrucomicrobia (miscellaneous)
  MG1-213 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLR

SEQ ID NO: 2033 - protein, 140 aa, Unknown
  Description of Unknown: uncultivated organism with predicted taxonomy: unclassified Verrucomicrobia (miscellaneous)
  MG1-214 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRCAKLGEILPEKLRSEKAAREFFKSYLDKIMPVDVAPKK

SEQ ID NO: 2034 - protein, 140 aa, Unknown; identical to SEQ ID NO: 1881
  Description of Unknown: uncultivated organism with predicted taxonomy: unclassified Verrucomicrobia (miscellaneous)
  MG1-215 RuvC-III domain

SEQ ID NO: 2035 - protein, 140 aa, Unknown
  Description of Unknown: uncultivated organism with predicted taxonomy: unclassified Verrucomicrobia (miscellaneous)
  MG1-216 RuvC-III domain
AETAHIAKLAQKIVCMHFGFQFGGLSGAKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2036 - protein, 138 aa, Unknown; identical to SEQ ID NO: 1904
  Description of Unknown: uncultivated organism with predicted taxonomy: Coraliomargarita sp. CAG:312
  MG1-217 RuvC-III domain

SEQ ID NO: 2037 - protein, 140 aa, Unknown; identical to SEQ ID NO: 1908
  Description of Unknown: uncultivated organism with predicted taxonomy: unclassified Verrucomicrobia (miscellaneous)
  MG1-218 RuvC-III domain

SEQ ID NO: 2038 - protein, 140 aa, Unknown; identical to SEQ ID NO: 1925
  Description of Unknown: uncultivated organism with predicted taxonomy: unclassified Verrucomicrobia (miscellaneous)
  MG1-219 RuvC-III domain

SEQ ID NO: 2039 - protein, 140 aa, Unknown; identical to SEQ ID NO: 1881
  Description of Unknown: uncultivated organism with predicted taxonomy: unclassified Verrucomicrobia (miscellaneous)
  MG1-220 RuvC-III domain

SEQ ID NO: 2040 - protein, 66 aa, Unknown
  Description of Unknown: uncultivated organism with predicted taxonomy: unclassified Verrucomicrobia (miscellaneous)
  MG1-221 RuvC-III domain
AETAHIAKLAQKIVCMHFGFQFGGLSGTKRVFAVPGALTSRIRKFYGLDRILHNSEAESENLSFEE

SEQ ID NO: 2041 - protein, 140 aa, Unknown; identical to SEQ ID NO: 1881
  Description of Unknown: uncultivated organism with predicted taxonomy: unclassified Verrucomicrobia (miscellaneous)
  MG1-222 RuvC-III domain

SEQ ID NO: 2042 - protein, 140 aa, Unknown
  Description of Unknown: uncultivated organism with predicted taxonomy: unclassified Verrucomicrobia (miscellaneous)
  MG1-223 RuvC-III domain
AETAHIAKLAQKIVCMHFGFQFGRLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2043 - protein, 140 aa, Unknown; identical to SEQ ID NO: 1964
  Description of Unknown: uncultivated organism with predicted taxonomy: unclassified Verrucomicrobia (miscellaneous)
  MG1-224 RuvC-III domain

SEQ ID NO: 2044 - protein, 138 aa, Unknown; identical to SEQ ID NO: 1904
  Description of Unknown: uncultivated organism with predicted taxonomy: Coraliomargarita sp. CAG:312
  MG1-225 RuvC-III domain

SEQ ID NO: 2045 - protein, 138 aa, Unknown; identical to SEQ ID NO: 1904
  Description of Unknown: uncultivated organism with predicted taxonomy: Coraliomargarita sp. CAG:312
  MG1-226 RuvC-III domain

SEQ ID NO: 2046 - protein, 138 aa, Unknown; identical to SEQ ID NO: 1904
  Description of Unknown: uncultivated organism with predicted taxonomy: Coraliomargarita sp. CAG:312
  MG1-227 RuvC-III domain

SEQ ID NO: 2047 - protein, 140 aa, Unknown
  Description of Unknown: uncultivated organism with predicted taxonomy: unclassified Verrucomicrobia (miscellaneous)
  MG1-228 RuvC-III domain
AETAHIAKLAQKIVCMHFGFQFGGLSGTKRVFTVPGALTSRIRKFYGLDRILHNSEAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2048 - protein, 140 aa, Unknown; identical to SEQ ID NO: 1881
  Description of Unknown: uncultivated organism with predicted taxonomy: Verrucomicrobia
  MG1-229 RuvC-III domain

SEQ ID NO: 2049 - protein, 140 aa, Unknown; identical to SEQ ID NO: 1881
  Description of Unknown: uncultivated organism with predicted taxonomy: Verrucomicrobia
  MG1-230 RuvC-III domain

SEQ ID NO: 2050 - protein, 140 aa, Unknown; identical to SEQ ID NO: 1881
  Description of Unknown: uncultivated organism with predicted taxonomy: unclassified Verrucomicrobia (miscellaneous)
  MG1-231 RuvC-III domain

SEQ ID NO: 2051 - protein, 142 aa, Unknown; identical to SEQ ID NO: 1949
  Description of Unknown: uncultivated organism with predicted taxonomy: Verrucomicrobia
  MG1-232 RuvC-III domain

SEQ ID NO: 2052 - protein, 140 aa, Unknown; identical to SEQ ID NO: 1933
  Description of Unknown: uncultivated organism
  MG1-233 RuvC-III domain

SEQ ID NO: 2053 - protein, 140 aa, Unknown; identical to SEQ ID NO: 1955
  Description of Unknown: uncultivated organism with predicted taxonomy: unclassified Verrucomicrobia (miscellaneous)
  MG1-234 RuvC-III domain

SEQ ID NO: 2054 - protein, 140 aa, Unknown; identical to SEQ ID NO: 1881
  Description of Unknown: uncultivated organism with predicted taxonomy: unclassified Verrucomicrobia (miscellaneous)
  MG1-236 RuvC-III domain

SEQ ID NO: 2055 - protein, 140 aa, Unknown; identical to SEQ ID NO: 1908
  Description of Unknown: uncultivated organism with predicted taxonomy: Verrucomicrobia
  MG1-237 RuvC-III domain

SEQ ID NO: 2056 - protein, 138 aa, Unknown; identical to SEQ ID NO: 1904
  Description of Unknown: uncultivated organism with predicted taxonomy: Coraliomargarita sp. CAG:312
  MG1-238 RuvC-III domain

SEQ ID NO: 2057 - protein, 140 aa, Unknown; identical to SEQ ID NO: 1830
  Description of Unknown: uncultivated organism with predicted taxonomy: unclassified Verrucomicrobia (miscellaneous)
  MG1-239 RuvC-III domain

SEQ ID NO: 2058 - protein, 140 aa, Unknown; identical to SEQ ID NO: 1881
  Description of Unknown: uncultivated organism with predicted taxonomy: unclassified Verrucomicrobia (miscellaneous)
  MG1-240 RuvC-III domain

SEQ ID NO: 2059 - protein, 138 aa, Unknown; identical to SEQ ID NO: 1904
  Description of Unknown: uncultivated organism with predicted taxonomy: Verrucomicrobia
  MG1-241 RuvC-III domain

SEQ ID NO: 2060 - protein, 138 aa, Unknown; identical to SEQ ID NO: 1904
  Description of Unknown: uncultivated organism with predicted taxonomy: Coraliomargarita sp. CAG:312
  MG1-242 RuvC-III domain

SEQ ID NO: 2061 - protein, 142 aa, Unknown; identical to SEQ ID NO: 1974
  Description of Unknown: uncultivated organism with predicted taxonomy: Verrucomicrobia
  MG1-243 RuvC-III domain

SEQ ID NO: 2062 - protein, 140 aa, Unknown; identical to SEQ ID NO: 1881
  Description of Unknown: uncultivated organism with predicted taxonomy: unclassified Verrucomicrobia (miscellaneous)
  MG1-244 RuvC-III domain

SEQ ID NO: 2063 - protein, 138 aa, Unknown; identical to SEQ ID NO: 1904
  Description of Unknown: uncultivated organism with predicted taxonomy: Coraliomargarita sp. CAG:312
  MG1-245 RuvC-III domain

SEQ ID NO: 2064 - protein, 140 aa, Unknown; identical to SEQ ID NO: 1940
  Description of Unknown: uncultivated organism with predicted taxonomy: unclassified Verrucomicrobia (miscellaneous)
  MG1-246 RuvC-III domain

SEQ ID NO: 2065 - protein, 138 aa, Unknown; identical to SEQ ID NO: 1904
  Description of Unknown: uncultivated organism with predicted taxonomy: Coraliomargarita sp. CAG:312
  MG1-247 RuvC-III domain

SEQ ID NO: 2066 - protein, 140 aa, Unknown; identical to SEQ ID NO: 1970
  Description of Unknown: uncultivated organism with predicted taxonomy: unclassified Verrucomicrobia (miscellaneous)
  MG1-248 RuvC-III domain

SEQ ID NO: 2067 - protein, 140 aa, Unknown; identical to SEQ ID NO: 1972
  Description of Unknown: uncultivated organism with predicted taxonomy: unclassified Verrucomicrobia (miscellaneous)
  MG1-249 RuvC-III domain

SEQ ID NO: 2068 - protein, 138 aa, Unknown; identical to SEQ ID NO: 1904
  Description of Unknown: uncultivated organism with predicted taxonomy: Coraliomargarita sp. CAG:312
  MG1-250 RuvC-III domain

SEQ ID NO: 2069 - protein, 138 aa, Unknown; identical to SEQ ID NO: 1904
  Description of Unknown: uncultivated organism with predicted taxonomy: Coraliomargarita sp. CAG:312
  MG1-251 RuvC-III domain

SEQ ID NO: 2070 - protein, 140 aa, Unknown; identical to SEQ ID NO: 1830
  Description of Unknown: uncultivated organism with predicted taxonomy: unclassified Verrucomicrobia (miscellaneous)
  MG1-252 RuvC-III domain

SEQ ID NO: 2071 - protein, 140 aa, Unknown; identical to SEQ ID NO: 1881
  Description of Unknown: uncultivated organism with predicted taxonomy: unclassified Verrucomicrobia (miscellaneous)
  MG1-253 RuvC-III domain

SEQ ID NO: 2072 - protein, 140 aa, Unknown; identical to SEQ ID NO: 1881
  Description of Unknown: uncultivated organism with predicted taxonomy: unclassified Verrucomicrobia (miscellaneous)
  MG1-254 RuvC-III domain

SEQ ID NO: 2073 - protein, 140 aa, Unknown; identical to SEQ ID NO: 1881
  Description of Unknown: uncultivated organism with predicted taxonomy: unclassified Verrucomicrobia (miscellaneous)
  MG1-255 RuvC-III domain

SEQ ID NO: 2074 - protein, 140 aa, Unknown; identical to SEQ ID NO: 1908
  Description of Unknown: uncultivated organism with predicted taxonomy: unclassified Verrucomicrobia (miscellaneous)
  MG1-256 RuvC-III domain

SEQ ID NO: 2075 - protein, 140 aa, Unknown; identical to SEQ ID NO: 1881
  Description of Unknown: uncultivated organism with predicted taxonomy: unclassified Verrucomicrobia (miscellaneous)
  MG1-257 RuvC-III domain

SEQ ID NO: 2076 - protein, 142 aa, Unknown; identical to SEQ ID NO: 1911
  Description of Unknown: uncultivated organism with predicted taxonomy: Verrucomicrobia
  MG1-258 RuvC-III domain

SEQ ID NO: 2077 - protein, 140 aa, Unknown; identical to SEQ ID NO: 1881
  Description of Unknown: uncultivated organism with predicted taxonomy: unclassified Verrucomicrobia (miscellaneous)
  MG1-259 RuvC-III domain

SEQ ID NO: 2078 - protein, 140 aa, Unknown; identical to SEQ ID NO: 1881
  Description of Unknown: uncultivated organism with predicted taxonomy: unclassified Verrucomicrobia (miscellaneous)
  MG1-260 RuvC-III domain

SEQ ID NO: 2079 - protein, 140 aa, Unknown; identical to SEQ ID NO: 1881
  Description of Unknown: uncultivated organism with predicted taxonomy: unclassified Verrucomicrobia (miscellaneous)
  MG1-261 RuvC-III domain

SEQ ID NO: 2080 - protein, 140 aa, Unknown; identical to SEQ ID NO: 1830
  Description of Unknown: uncultivated organism with predicted taxonomy: unclassified Verrucomicrobia (miscellaneous)
  MG1-262 RuvC-III domain

SEQ ID NO: 2081 - protein, 138 aa, Unknown; identical to SEQ ID NO: 1976
  Description of Unknown: uncultivated organism with predicted taxonomy: Verrucomicrobia
  MG1-263 RuvC-III domain

SEQ ID NO: 2082 - protein, 140 aa, Unknown; identical to SEQ ID NO: 1830
  Description of Unknown: uncultivated organism with predicted taxonomy: unclassified Verrucomicrobia (miscellaneous)
  MG1-264 RuvC-III domain

SEQ ID NO: 2083 - protein, 140 aa, Unknown; identical to SEQ ID NO: 1982
  Description of Unknown: uncultivated organism with predicted taxonomy: unclassified Verrucomicrobia (miscellaneous)
  MG1-265 RuvC-III domain

SEQ ID NO: 2084 - protein, 138 aa, Unknown; identical to SEQ ID NO: 1904
  Description of Unknown: uncultivated organism with predicted taxonomy: Coraliomargarita sp. CAG:312
  MG1-266 RuvC-III domain

SEQ ID NO: 2085 - protein, 142 aa, Unknown; identical to SEQ ID NO: 1928
  Description of Unknown: uncultivated organism with predicted taxonomy: Verrucomicrobia
  MG1-267 RuvC-III domain

SEQ ID NO: 2086 - protein, 140 aa, Unknown; identical to SEQ ID NO: 1923
  Description of Unknown: uncultivated organism with predicted taxonomy: Verrucomicrobia
  MG1-268 RuvC-III domain

SEQ ID NO: 2087 - protein, 140 aa, Unknown; identical to SEQ ID NO: 1881
  Description of Unknown: uncultivated organism with predicted taxonomy: unclassified Verrucomicrobia (miscellaneous)
  MG1-269 RuvC-III domain

SEQ ID NO: 2088 - protein, 138 aa, Unknown; identical to SEQ ID NO: 1921
  Description of Unknown: uncultivated organism with predicted taxonomy: Verrucomicrobia
  MG1-270 RuvC-III domain

SEQ ID NO: 2089 - protein, 140 aa, Unknown; identical to SEQ ID NO: 1908
  Description of Unknown: uncultivated organism with predicted taxonomy: unclassified Verrucomicrobia (miscellaneous)
  MG1-271 RuvC-III domain

SEQ ID NO: 2090 - protein, 203 aa, Unknown
  Description of Unknown: uncultivated organism
  MG1-272 RuvC-III domain
QRTAYIARCLRYVCLLKFGWLSPEDRDPGHEKANDATRSYLVTNGGTTRRLRQAWNLDELLRETVSPEKWAGMTDVEKERALAQGARIPTEEWKKLDKAKQDDVLRARRTKNRQDVRHHALDAMVVACTLPWAANLTVWASGWCNLDTDDGSVSSVRCPIFGENDFGEGIYAAIEAKLSELKTALPEATSNAITHYRSHERHK

SEQ ID NO: 2091 - protein, 198 aa, Unknown
  Description of Unknown: uncultivated organism with predicted taxonomy: Rhizobiales
  MG1-273 RuvC-III domain
QQTAYIARCLREACLIIFGKEWLDWTDGAGRDPRLLTDNRASKNYLTTNGVITSRLRGAWHLNEVLWPKPERLNDTEWDKLTDDEKIPLKAKYKEERELRALKNRQDHRHHAIDAMVISCAMPWQTCKTRTGSQQSDDGLCEVDSETGAITKIWNPVFNDYGYGIKQAAEAKSALLLKFSSERQVDLLRHHKSNNRNA

SEQ ID NO: 2092 - protein, 198 aa, Unknown
  Description of Unknown: uncultivated organism
  MG1-274 RuvC-III domain
QQTAYIARCLREACLIHFGKEWLDWTDGAGRDPRLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNA

SEQ ID NO: 2093 - protein, 125 aa, Unknown; identical to SEQ ID NO: 1839
  Description of Unknown: uncultivated organism
  MG1-275 RuvC-III domain

SEQ ID NO: 2094 - protein, 123 aa, Unknown
  Description of Unknown: uncultivated organism with predicted taxonomy: Verrucomicrobia bacterium IMCC26134
  MG1-276 RuvC-III domain
AETAWISKLAQTIVGLRFGWPGGIVDGKRKVIVVSGGLTGRIRRKYKLNRLLNPNASSEEEAETKNRDDDRHHALDAMVISFIPNWTRNAKLAGFFRFPEGVHGEFFANEIADVVPKNVALEK

SEQ ID NO: 2095 - protein, 174 aa, Unknown
  Description of Unknown: uncultivated organism
  MG1-277 RuvC-III domain
QHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKR

SEQ ID NO: 2096 - protein, 166 aa, Unknown
  Description of Unknown: uncultivated organism
  MG1-279 RuvC-III domain
QHTAYIARVIRHISLIQLGWLNDAGRDPTPEKQNPALSFQVTNGQLTSRLRKSWGLNQILHPLPPGKRWDELTDEEQTQFTEKNRGDLRHHSLDAMVIACTLPWLAHRTHGATDQFGHHGWWTQDEKQRSKAANPLFPNEGQMHDVVKKEIEKVIVRHHVSRSNHK

SEQ ID NO: 2097 - protein, 203 aa, Unknown; identical to SEQ ID NO: 2090
  Description of Unknown: uncultivated organism
  MG1-280 RuvC-III domain

SEQ ID NO: 2098 - protein, 174 aa, Unknown; identical to SEQ ID NO: 2095
  Description of Unknown: uncultivated organism with predicted taxonomy: Thermoflexibacter ruber
  MG1-281 RuvC-III domain

SEQ ID NO: 2099 - protein, 174 aa, Unknown; identical to SEQ ID NO: 2095
  Description of Unknown: uncultivated organism
  MG1-282 RuvC-III domain

SEQ ID NO: 2100 - protein, 137 aa, Unknown
  Description of Unknown: uncultivated organism with predicted taxonomy: Verrucomicrobia bacterium IMCC26134
  MG1-283 RuvC-III domain
AETAWVSKLAQTIANLRFNWTNGYDQNRKKRVIVISGGVTARVRRKYGLDKLLYNKDTDAEVFAKKLKNRADKRHHALDAMVLTFVPQWARDPGKEGFFRFPAEFRDANGREDYEQIRKLFGDSIAKVMPRYLTYER

SEQ ID NO: 2101 - protein, 172 aa, Unknown
  Description of Unknown: uncultivated organism
  MG1-284 RuvC-III domain
QHTAYIARVIRQVSLIQLGWLAEDGRDATGLKDPEMTAWRFQVTNGSLTSRLRKSWGLNQILNPFPSKDAWEAMTPEEQEKKKTEMQEKNRGDLRHHSLDAMVIACTLPWLAHRTHGAKDSFGRPGWWWLDEKKRSQASTPIFPKEGQMHEVVKKEIEKVLVRHHVSRSNHQ

SEQ ID NO: 2102 - protein, 127 aa, Unknown
  Description of Unknown: uncultivated organism with predicted taxonomy: Verrucomicrobia
  MG1-285 RuvC-III domain
AETAWIAKLAQAIVGLHFGWRNGVDESGNKRVTVISGGLTGRIRRKYALNQILNPNAKTEEEAEKKNRDDDRHHALDAMVISFIPSWVRDAMKEKFFRFPEPIHQNAKGFFEKEIQSVKPRNIALQK

SEQ ID NO: 2103 - protein, 137 aa, Unknown; identical to SEQ ID NO: 1831
  Description of Unknown: uncultivated organism with predicted taxonomy: Verrucomicrobia
  MG1-287 RuvC-III domain

SEQ ID NO: 2104 - protein, 137 aa, Unknown; identical to SEQ ID NO: 1831
  Description of Unknown: uncultivated organism
  MG1-288 RuvC-III domain

SEQ ID NO: 2105 - protein, 146 aa, Unknown
  Description of Unknown: uncultivated organism with predicted taxonomy: Deltaproteobacteria bacterium RIFOXYA12_FULL_61_11
  MG1-290 RuvC-III domain
TQTAYIARALRGLCLLRQNWLTPEGRDPSDQPGGPGQFFQLTNGYLTAGIRRCWGLDELLPSALDDEGGKNRHDLRHHALDAAVIACTLPWAAHQPLSRGGWREAPPFGSARREQWRTPFDHLRSQIRARVPDIVPTQKVGTSAKQ

SEQ ID NO: 2106 - protein, 126 aa, Unknown
  Description of Unknown: uncultivated organism with predicted taxonomy: Candidatus Termititenax aidoneus
  MG1-291 RuvC-III domain
AETAYITKLTQKIAHLFFGWDWQTKGSHRKIIVQSGGYTSKIRKIFKLNALLYPEKTGDEIREIVETGKNRDNKRHHALDALVLSITPEIKYDEKKDADVYPVWFNPEYCKNALDKVNPTYIDFEK

SEQ ID NO: 2107 - protein, 133 aa, Unknown
  Description of Unknown: uncultivated organism with predicted taxonomy: Candidatus Termititenax aidoneus
  MG1-292 RuvC-III domain
SQTAYISKLAQKVTALTFGWGMQTKDDNRNIVIATGGQTARIRSRFKLDRLLHSGMTDEEFEKALRNGEIEKKNRSNPRHHALDALVLSAVPEIRVDKNRKGKYDDIYPSWLTRDFCEKEVAHVYPKQIKFSK

SEQ ID NO: 2108 - protein, 133 aa, Unknown; identical to SEQ ID NO: 2107
  Description of Unknown: uncultivated organism with predicted taxonomy: Elusimicrobia bacterium HGW-Elusimicrobia-1
  MG1-293 RuvC-III domain

SEQ ID NO: 2109 - protein, 129 aa, Unknown
  Description of Unknown: uncultivated organism with predicted taxonomy: Endomicrobium proavitum
  MG1-294 RuvC-III domain
QATSQIEKEAQTIASLLFGWGINTKGDKKKILFFTGGNTADVRKNLNLNRLLHPALSDEEYNELKKKKDFKDKNRKNTKHHALDALVLSVLPEITMDKKSIENKPEFFNIKFCEEQLKKVYPIIIKQTK

SEQ ID NO: 2110 - protein, 124 aa, Unknown
  Description of Unknown: uncultivated organism with predicted taxonomy: Verrucomicrobia bacterium 12-59-8
  MG1-295 RuvC-III domain
AETAYIARVARDVAALRCGWQPGEAGEKRHIHIINGANTAKVRGLYHLNSLLASDQGGLEPDKFMKKVRENKKHHALDAMVLSFIREWIRNPKTRQYEFPAGIDREYFRKCLENVVPYNCILPK

SEQ ID NO: 2111 - protein, 129 aa, Unknown
  Description of Unknown: uncultivated organism
  MG1-296 RuvC-III domain
QATMYIEKYAQKITALFFGWGEQTKGDERHIFVCNGGLTAKLRKENGLDRLLWSEEEFYKLMASGKLDEKNRENKKHHALDALVISFADDLRTDPKTGRKLFPEFAQNNPAFFSEAMDKVFPKQLRKKA

SEQ ID NO: 2112 - protein, 124 aa, Unknown; identical to SEQ ID NO: 2110
  Description of Unknown: uncultivated organism with predicted taxonomy: Verrucomicrobia bacterium 12-59-8
  MG1-297 RuvC-III domain

SEQ ID NO: 2113 - protein, 130 aa, Unknown
  Description of Unknown: uncultivated organism
  MG1-298 RuvC-III domain
QATRYIEKLAQKLISLYFGWGEQTTGDKRKMFVCTGGLTAKIRSQYGLNRLLHKDLSGEEFKKIVAEGKLDEKNRNNKRHHALDALVISFTRDIKYDNKGKPVLPDYACNPAFFADAIEKVFPVTIRSKK

SEQ ID NO: 2114 - protein, 127 aa, Unknown
  Description of Unknown: uncultivated organism
  MG1-299 RuvC-III domain
AETAWISRLAQKIADLSFGWKNGIDAAGRKRTVVVSGGLTARIRRKYGLNRILNPGASSEEEAEKKNRSDKRHHALDAMTISFIPQWARDPGKTGFFRFPKAIRDNPLPFFQARIDAVVPRQLCYEK

SEQ ID NO: 2115 - protein, 127 aa, Unknown
  Description of Unknown: uncultivated organism
  MG1-300 RuvC-III domain
AETAWISRLSQKIIDLTFGWSNGVDASGRKRSIIVSGGLTARIRRKYHLNHILNPDAETDEEAEKKNRKDKRHHALDAMTISFIPQWARDPDKTGFFRLPKEIRDNPLPFFAKRIDTVIPRQLCFEK

SEQ ID NO: 2116 - protein, 127 aa, Unknown
  Description of Unknown: uncultivated organism
  MG1-301 RuvC-III domain
AETAWISRLAQKIADLTFGWQNGVDAAGRKRTIIVSGGLTARIRRKYGLNRLLNPDASSEEEAEKKNRSDKRHHALDAMTISFIPQWARDPDKTGFFRFPKEIRDNSLPFFKARIDAVVPRQLCYEK

SEQ ID NO: 2117 - protein, 127 aa, Unknown
  Description of Unknown: uncultivated organism
  MG1-302 RuvC-III domain
AETAWISRLAQKIADLAFGWHNGVDAAGRKRTVVVSGGLTARIRRKYGLNRILNPNVATEEEAEKKNRADKRHHALDAMTISFIPQWARDPDKTGFFRLPREIRDNPWPFFQARIDAVVPRQLCYEK

SEQ ID NO: 2118 - protein, 127 aa, Unknown; identical to SEQ ID NO: 2117
  Description of Unknown: uncultivated organism
  MG1-303 RuvC-III domain

SEQ ID NO: 2119 - protein, 173 aa, Unknown
  Description of Unknown: uncultivated organism with predicted taxonomy: Verrucomicrobia
  MG1-304 RuvC-III domain
AATSWIARITQSIVRLHFGWQLDDEPGKEKVMTISGGLTARIRRKYLLDSLLGTDKESQKVCEQVDQVLAEMEKLKSQPRSEETKVQWRELSQKRSQLARDSEKNRGDQRHHALDAMLLTFLPNWARDRNKEDFLRLEDIGDNAPYTDEGKRNAEKITDEIKKLVEETKPIYK

SEQ ID NO: 2120 - protein, 127 aa, Unknown
  Description of Unknown: uncultivated organism with predicted taxonomy: Verrucomicrobia bacterium IMCC26134
  MG1-305 RuvC-III domain
AETAWISRLAQKIADLSFGWQNGVDAAGRKRTIVVSGGLTARIRRKYGLNRLLNPNATSEEEAEKKNRADKRHHALDAMTISFIPQWARDPDKTGFFRFPKEIRDNPHPFFQARIEAVVPRQLCYEK

SEQ ID NO: 2121 - protein, 123 aa, Unknown
  Description of Unknown: uncultivated organism with predicted taxonomy: Verrucomicrobia
  MG1-306 RuvC-III domain
AETAWISKLAQTIIGLRFGWPNGIANGERKVIVISGGLTGRIRRKYKLNSLLNPDAKSEEEAEIKNRGDDRHHALDAMVISFLPTWARNSRFTGFFRFPDEVTRELFKREIAEVIPQNVCFER

SEQ ID NO: 2122 - protein, 198 aa, Unknown
  Description of Unknown: uncultivated organism with predicted taxonomy: Verrucomicrobia bacterium IMCC26134
  MG1-307 RuvC-III domain
QQTAYIARCLREACLIHFGKEWLDWTDGAGRDPLLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNA

SEQ ID NO: 2123 - protein, 127 aa, Unknown
  Description of Unknown: uncultivated organism
  MG1-308 RuvC-III domain
QLARQLRRMICFWMGIQEDSKETRERIGNPSGLHTAAARRGWKITKDRSDLTHHRMDAAVLSFIPPGAGLNSVMYGGIFEEVHSTKEINGNKFKVVQMRGAPELKPDLSALKKDSLTECPVINIRSK

SEQ ID NO: 2124 - protein, 152 aa, Unknown
  Description of Unknown: uncultivated organism
  MG1-309 RuvC-III domain
QLARELRRRVVEWLGIERRHAGIADPTQRALAREAEERRRVAAPAGALTAACREAWKDRLPEAYFTPIEIRGQTVLTKNRGNLRHHMWDAGVLAHIPPGDGLNHVRYGGIFETADIGGAPRPVPLPELAPDLAEIEKADPLACRVFHLRPRH

SEQ ID NO: 2125 - protein, 137 aa, Unknown
  Description of Unknown: uncultivated organism
  MG1-310 RuvC-III domain
QLARQLRAEIMRWMQVDDKPDEAARRIGTPSGWLAAQARKSWLPAEEYEKVRNNVTHHLIDAAILAHIPPREGMNSVPCKGIFYVESVPVRDPVTGDTTYRLETKALPELSPLPRLKHWLPDNGEYDVCPVWKPRRQ

SEQ ID NO: 2126 - protein, 137 aa, Unknown
  Description of Unknown: uncultivated organism
  MG1-311 RuvC-III domain
QLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQ

SEQ ID NO: 2127 - protein, 137 aa, Unknown; identical to SEQ ID NO: 2126
  Description of Unknown: uncultivated organism
  MG1-312 RuvC-III domain

SEQ ID NO: 2128 - protein, 127 aa, Unknown; identical to SEQ ID NO: 2123
  Description of Unknown: uncultivated organism
  MG1-314 RuvC-III domain

SEQ ID NO: 2129 - protein, 137 aa, Unknown
  Description of Unknown: uncultivated organism with predicted taxonomy: Verrucomicrobia bacterium
  MG1-315 RuvC-III domain
QLARQLRAEVMRWMHVEDQPDEAARRIGTPSGWLVAQARKSWLAASDYQKVRNNLTHHLIDAAVLAHIPPREGMNSIICKGIFYDVRERVRDEATGITSHRFLTKALPELSPLPRLKQWLPDNGEYAVCPVLKPRHQ

SEQ ID NO: 2130 - protein, 198 aa, Unknown; identical to SEQ ID NO: 2092
  Description of Unknown: uncultivated organism with predicted taxonomy: Thiorhodospira sibirica
  MG1-316 RuvC-III domain

SEQ ID NO: 2131 - protein, 137 aa, Unknown
  Description of Unknown: uncultivated organism
  MG1-317 RuvC-III domain
QLARQLRAEVMRWMKVEGDPDEAARRIGTPSGWLAAQARKSWLAQGDYEKVRNNLTHHLIDAAVLAHIPPREGMNSVLYKGIFYVVREPVRNEITGTTSQRLLTKALPQLSPLPRLNHWLPDNGEYAVCPVLKPRRQ

SEQ ID NO: 2132 - protein, 137 aa, Unknown; identical to SEQ ID NO: 2126
  Description of Unknown: uncultivated organism
  MG1-318 RuvC-III domain

SEQ ID NO: 2133 - protein, 130 aa, Unknown
  Description of Unknown: uncultivated organism with predicted taxonomy: Verrucomicrobia bacterium IMCC26134
  AKC83434.1 RuvC-III domain
AETAYIARLAQTVAALHFGWPINSQPGERRITIVNGGLTARVRRNYRLNSLLNPCPTGKDQKEWEEDADVEKNRKDDRHHALDAMVISFIPAWTRDPKKEKFFRLPDGVTPETFQERLEEVLPRQLHYER

SEQ ID NO: 2134 - protein, 130 aa, Unknown; identical to SEQ ID NO: 2133
  Description of Unknown: uncultivated organism with predicted taxonomy: Verrucomicrobia bacterium IMCC26134
  AKC83434.1 RuvC-III domain

SEQ ID NO: 2135 - protein, 123 aa, Unknown
  Description of Unknown: uncultivated organism with predicted taxonomy: Verrucomicrobia bacterium 61-8
  OJV06180.1 RuvC-III domain
AETAWIAKLSQAILDAFFGWKNGVDDEGRKRVISVNGGLTARIRRKYQLNSILNPSLNEEEAEKKNRSDKRHHALDAMVINFIPSWTRDTAKEHFFRFPSGIHRETFVQQIANVTPRNLCLEK

SEQ ID NO: 2136 - protein, 123 aa, Unknown; identical to SEQ ID NO: 2135
  Description of Unknown: uncultivated organism with predicted taxonomy: Verrucomicrobia bacterium 61-8
  OJV06180.1 RuvC-III domain

SEQ ID NO: 2137 - protein, 137 aa, Unknown
  Description of Unknown: uncultivated organism with predicted taxonomy: Pedosphaera sp. Tous-C6FEB
  PAW75411.1 RuvC-III domain
AETAWVSKLAQAIVNLTFGWTNANDEEGRKRVIVVSGGLTARVRRKYSLDKLLYTNTTDPEVLTKQVKNRSDKRHHALDAMVLTYIPQWARDPGKEGFFRFPAEFRDATGREDYSAIQRLFKDKLAKTTPRFLAYER

SEQ ID NO: 2138 - protein, 137 aa, Unknown; identical to SEQ ID NO: 2137
  Description of Unknown: uncultivated organism with predicted taxonomy: Pedosphaera sp. Tous-C6FEB
  PAW75411.1 RuvC-III domain

SEQ ID NO: 2139 - protein, 130 aa, Unknown; identical to SEQ ID NO: 2133
  Description of Unknown: uncultivated organism with predicted taxonomy: Verrucomicrobia bacterium IMCC26134
  WP_082083265.1 RuvC-III domain

SEQ ID NO: 2140 - protein, 130 aa, Unknown; identical to SEQ ID NO: 2133
  Description of Unknown: uncultivated organism with predicted taxonomy: Verrucomicrobia bacterium IMCC26134
  WP_082083265.1 RuvC-III domain

SEQ ID NO: 2141 - protein, 156 aa, Unknown; identical to SEQ ID NO: 1899
  Description of Unknown: uncultivated organism
  MG2-1 RuvC-III domain

SEQ ID NO: 2142 - protein, 174 aa, Unknown
  Description of Unknown: uncultivated organism
  MG2-7 RuvC-III domain
TQTSHLNKMAIRLVKQRIGIDAKHLPGNVTAFIRQKLHIDECLFNAVPRLQTAAKGQPKSSKRKKKAEEAPVEPIQDDMPPRKLTKADIRELTYLHHAMDAVTQGLALLLFAPEDWPLLVKRNLPDSEQRHLKARYPFLDFSADKHISIQDLPEDTLHTISERLAECRVVRHIP

SEQ ID NO: 2143 - protein, 206 aa, Unknown
  Description of Unknown: uncultivated organism
  MG2-3 RuvC-III domain
TITSHLNRLAQQVLLRSLPHLAEHQITAIPGSVIGVLRDAPGWRLLGCLDGAATADVIRKVLQLDHEGKPMCASDVAPLMKRIPKPKGEIRELTHLHHAVDACAIAIINHLLPKDGKLWELVAKRELTDADKNAYDDLRQKNQSQWQPRRLARLFSIVPNLDDKGQQPKHDHKWRIRPCRLKDVLPDIGAQVNKCLRERRVVEHTP

SEQ ID NO: 2144 - protein, 161 aa, Unknown
  Description of Unknown: uncultivated organism with predicted taxonomy: Verrucomicrobia
  MG2-5 RuvC-III domain
TQTSQLVRLAAQALRRNLPHLGPENVVSLPGSVTGMVRKSWNVTGCLELACPQVMEEVVDQDGKAVRRAKDKGEIRGITHLHHALDACVIGFSSHFIPNNGGLWELMVKRRWTPAEEKELEARRVFSKGMDGRFQMTDLHKRHKEAIRQRLAEKRVVQHIP

SEQ ID NO: 2145 - protein, 153 aa, Unknown
  Description of Unknown: uncultivated organism with predicted taxonomy: Verrucomicrobia bacterium
  MG2-6 RuvC-III domain
TQTSQLVRLAAQVIRKKYVDSKEPKIVSMPGSVTAVFRKSWKVMGCLSKAVPAILDENGEVRPKDEIRNITHLHHAIDACVLALASHLFPNNGRLWELLVKNKLNSSEVDELKKIPLVQVGVDNKINISDLPEFIKEQISNRLLERRVVQHIS

SEQ ID NO: 2146 - protein, 154 aa, Unknown
  Description of Unknown: uncultivated organism with predicted taxonomy: Verrucomicrobia
  MG2-8 RuvC-III domain
TVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIP

SEQ ID NO: 2147 - protein, 154 aa, Unknown; identical to SEQ ID NO: 2146
  Description of Unknown: uncultivated organism with predicted taxonomy: Verrucomicrobia
  MG2-10 RuvC-III domain

SEQ ID NO: 2148 - protein, 156 aa, Unknown
  Description of Unknown: uncultivated organism
  MG2-11 RuvC-III domain
TQTSQLVRLGAQILKKGFTGLERQPVITSMPGSVTGVMRKGWNLIGCLSAANPNVLDEIGQPKIKTEIRDITHLHHALDACVLVLASYFIPNKGAVWELIVKRRLDETEQLQLRTATRGIFNFSPGRRFGLADLPNSLKEQIRQRLAERRVVQHVP

SEQ ID NO: 2149 - protein, 28 aa, Unknown
  Description of Unknown: uncultivated organism with predicted taxonomy: Verrucomicrobia bacterium
  MG2-12 RuvC-III domain
TKTRFINKLAAQQLQAAFRDLPEQQRPP

SEQ ID NO: 2150 - protein, 156 aa, Unknown
  Description of Unknown: uncultivated organism with predicted taxonomy: Verrucomicrobia bacterium
  MG2-13 RuvC-III domain
TQTSQLVRLGAQVLKKGFTGLERQPVITSMPGSVTGVMRKGWNLIGCLSAANPNVLDEIGQPKIKTEIRDITHLHHALDACVLALVSHFIPNNGGVWELIVKRRLDETEQLQLRAATHGIFNFSPGRRFGLADLPDSLKEQIRQRLAERRVVQHVP

SEQ ID NO: 2151 - protein, 156 aa, Unknown
  Description of Unknown: uncultivated organism with predicted taxonomy: Verrucomicrobia bacterium
  MG2-14 RuvC-III domain
SQTSYLNKLAVQQANHWFRQQLGLDTKLPLVIQLSGSVTAAIRTGWDLFGQLNEVCPATRNKTKTEVREITHLHHALDAIVIGLSAHYFPRDKRLWSLMSRRAVKNSVDQAYMKQQLGDLVCFNSDGKWKLQELDIGIKKQVAARLSEKRVVRHNP

SEQ ID NO: 2152 - protein, 156 aa, Unknown; identical to SEQ ID NO: 2151
  Description of Unknown: uncultivated organism with predicted taxonomy: Verrucomicrobia bacterium
  MG2-15 RuvC-III domain

SEQ ID NO: 2153 - protein, 153 aa, Unknown
  Description of Unknown: uncultivated organism with predicted taxonomy: Verrucomicrobia bacterium
  MG2-16 RuvC-III domain
TQTSQLARMAAQMVKRTFQDVEQKPVIVSMPGSVTSTVRKGWDLLGCLSKACPEVLDETGQVKTKSEIRDITHLHHALDACVLGLAAHFIPNNGDIWKLIIKQDLNETEKDLLRPLGIFDIGEKRFRLKDLPNELKNQLRERLAELRVVQHIP

SEQ ID NO: 2154 - protein, 206 aa, Unknown; identical to SEQ ID NO: 2143
  Description of Unknown: uncultivated organism
  MG2-17 RuvC-III domain

SEQ ID NO: 2155 - protein, 153 aa, Unknown
  Description of Unknown: uncultivated organism with predicted taxonomy: Verrucomicrobia
  MG2-18 RuvC-III domain
TQTSQLVRLGAQMLKRPFLREKHQPVITSMPGSVTGEVRKGWNLLGCLSKACPQVLDENGEVRTKTEIREITHLHHALDACVLGLAAHFIPNNGRIWELIVKRNLTDTEKLQLRALGIFDFSPEGFRLKELPDELKNQIRERLAERRVVQHVP

SEQ ID NO: 2156 - protein, 156 aa, Unknown
  Description of Unknown: uncultivated organism with predicted taxonomy: Verrucomicrobia
  MG2-19 RuvC-III domain
TQTSQLVRLAVQVLKKKYIGEKEKPVFVSMPGSITGKFRAAWNLLGCLLKAVPWAADEDNQVKPKDELRNITHLHHAIDACVLALAGHFIPTYKNGKVWELMIKGTVKPSEKSYIEDVPMLQLDSENRLHIKDLPDSIKEQITERLYERRVVQHIP

SEQ ID NO: 2157 - protein, 189 aa, Unknown
  Description of Unknown: uncultivated organism with predicted taxonomy: Verrucomicrobia bacterium
  MG2-20 RuvC-III domain
TVTSHLVRLGAQVLQRAFPPEQRPPVISLPGSVTGEVRKAWKVTACLEAANPAVMEVVEEPDPQTGEMRRIRRAKKKEDIRGITHLHHALDACVLGLASLYFPRHGAVWSAAVKAGQHAATEYDNNEHPLWQAMTKRRPTAQEVVLLKATGLYDGPDSNGRMQLRDLPAELKGQIRRRLAEKRVVQHIP

SEQ ID NO: 2158 - protein, 156 aa, Unknown
  Description of Unknown: uncultivated organism
  MG2-21 RuvC-III domain
TQTSQLVRLAVQVLMKKYIGEKEKPVFVSMPGSITGKFRAGWNLLGCLLKAVPWAADEDNQVKPKDELRNITHLHHAIDACVLALAAHFIPTYKNGKVWELMFKGTVKPSEKMYIEDVPVLQLDSENRLHIKDLPDSIKEQITERLYERRVVQHIP

SEQ ID NO: 2159 - protein, 206 aa, Unknown; identical to SEQ ID NO: 2143
  Description of Unknown: uncultivated organism
  MG2-22 RuvC-III domain

SEQ ID NO: 2160 - protein, 152 aa, Unknown
  Description of Unknown: uncultivated organism with predicted taxonomy: Verrucomicrobia bacterium
  MG2-23 RuvC-III domain
TQTSQLVRLGAQMLKRPFLGEKHQPVITSLPGSVTGVVRKGWNLLGCLSKACPQVLDETGEVRTKTDIREITHLHHAVDACVLGLAAHFVPNNGRMELIVKRNLTETEKLQLRALGVFDFSPDGFRLKELPEGLKNQIRDRLAERRVVQHIP

SEQ ID NO: 2161 - protein, 185 aa, Unknown
  Description of Unknown: uncultivated organism with predicted taxonomy: Verrucomicrobia bacterium
  MG2-24 RuvC-III domain
TVTSHLVRLGAQVLQRVFPKDQRPPVVSLPGSVTGEVRKAWRLTGCLEAANPAVMEEVQERNPDTGELQTVRRPKKKDEIRGITHLHHALDACVLGLASLCFPRHGAVWSAMVKAGGDREADDDRRLWLAMTKRRPTPQEATLLKATGRYQQDSEGRLHLADLDEQLKQQIRARLAEKRVVQHVP

SEQ ID NO: 2162 - protein, 175 aa, Unknown
  Description of Unknown: uncultivated organism
  MG2-25 RuvC-III domain
TLTSQLVRLGAQVIKRFFAGGARVNNPREAPTDSTARGFVNPRSGPRITSLPGAVTGAVRKGWRVLGCLAQAAPQILEPTGEPKSKTDIRDLTHLHHALDACVLALAAHYFPKDGSLWEAMIVRAPNAAQKQLLHATGFYEFIAEDKPNLKDLPIELKQQIANRLAEKRVVQHIP

SEQ ID NO: 2163 - protein, 156 aa, Unknown
  Description of Unknown: uncultivated organism with predicted taxonomy: Verrucomicrobia bacterium
  MG2-26 RuvC-III domain
TQTSQLVRLGAQVLQRAYLGLARPPVVTSLPGSVTGTVRKGWDLLGCLATANPGVLDESGEVKNKTEIRDITHLHHALDACVLALAARAIPNNGRVWELLTRRDNGLNEVERQQLLALGIYARDSEGRLVLRDLSPDLNEQVRQRLAERRVVQHIP

SEQ ID NO: 2164 - protein, 161 aa, Unknown
  Description of Unknown: uncultivated organism
  MG2-27 RuvC-III domain
TQTSHLVRLAAEELKKEFGGVQCSTRIVSMPGSVTAETRKAWKLEACLAQANPEVAELRERRKTEPAPVSIKQELRDISHLHHALDACVLACAAHYLEKKGNIWKALVQRRKSEAENLELLSTGLFKRGQDGQARLQDLPAQLKNQISRVLAECRVVQHIP

SEQ ID NO: 2165 - protein, 154 aa, Unknown
  Description of Unknown: uncultivated organism with predicted taxonomy: Verrucomicrobia
  MG2-28 RuvC-III domain
TQTSQLARLAAQILRTPFNDTSNPPEIVSLPGFVTATVRRSWDVLGCLSQAAPGVLNTDGSTRSKTEIRNITHLHHALDACVIGLASHFIPNRGDVWRLLAQRNLRAWEKQQLADLGVFDFDAHGGLRLRDLPQQLKEQLRQRLTERRVVQHVP

SEQ ID NO: 2166 - protein, 152 aa, Unknown
  Description of Unknown: uncultivated organism with predicted taxonomy: Verrucomicrobia bacterium
  MG2-29 RuvC-III domain
TISSYVAKLAVGQIKKEFSELSKKPPVISLPGRLTGEARKSWKLLGLLSAVNENITSETPKNDIRGLTHLHHAMDAAVMGLMAHCADNLSDGTSWQLLLKRNLRPEEKNLLKANMRNIGFDGNRAHLLDVPNEIKEQLRRCLLERRVVQHVP

SEQ ID NO: 2167 - protein, 153 aa, Unknown
  Description of Unknown: uncultivated organism with predicted taxonomy: Verrucomicrobia bacterium
  MG2-30 RuvC-III domain
TLTSYVTKLALQQIKNQFDTCRKKPQVIALPGRLTGETRKTWKLMGLLHVVNEKIDGKTLKNDIRSMSHLHHAIDATIMGLLAYYIKDLADGTTWQLLLKRYLTASEIQHLKDNLNHFKIDSKNRAHLCDIPSHVQKQIEQCLKERRVVQHVP

SEQ ID NO: 2168 - protein, 153 aa, Unknown; identical to SEQ ID NO: 2167
  Description of Unknown: uncultivated organism with predicted taxonomy: Verrucomicrobia bacterium
  MG2-31 RuvC-III domain

SEQ ID NO: 2169 - protein, 153 aa, Unknown; identical to SEQ ID NO: 2167
  Description of Unknown: uncultivated organism with predicted taxonomy: Verrucomicrobia bacterium
  MG2-32 RuvC-III domain

SEQ ID NO: 2170 - protein, 66 aa, Unknown
  Description of Unknown: uncultivated organism with predicted taxonomy: Verrucomicrobia bacterium
  MG2-33 RuvC-III domain
TLTSYVTKLALQQIKNQFDTCRKKPQVIALPGRLTGETRKTWKLMGLLHVVNEKIDGKTLKNDIRS

SEQ ID NO: 2171 - protein, 66 aa, Unknown; identical to SEQ ID NO: 2170
  Description of Unknown: uncultivated organism with predicted taxonomy: Verrucomicrobia bacterium
  MG2-34 RuvC-III domain

SEQ ID NO: 2172 - protein, 156 aa, Unknown
  Description of Unknown: uncultivated organism with predicted taxonomy: Thermogutta terrifontis
  MG2-35 RuvC-III domain
TQTSYLNKLAAQQVQRWFSDQLDEDVKLPPVVQLSGSVTAAVRRSWDLFDQLQQVCPETRGKSKSDIRGMTHLHHALDAVTVGLAAHLFPKDGHLWALMSKRKITRPSDRDYMRSRLGDLVSFNNDGKWRLEALPESLLFEVAGKLAEQRVVRHMP

SEQ ID NO: 2173 - protein, 157 aa, Unknown
  Description of Unknown: uncultivated organism with predicted taxonomy: Coraliomargarita sp. CAG:312
  MG2-36 RuvC-III domain
TQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLP

SEQ ID NO: 2174 - protein, 94 aa, Unknown
  Description of Unknown: uncultivated organism with predicted taxonomy: Coraliomargarita sp. CAG:312
  MG2-37 RuvC-III domain
TQTSHLNKLAFKVVDSLYVDSEEKPELVHLPGSVTSVLRTNWDLSACMAKACPEIIVTVKSADSASGERGMGGDGLPQGLNGSVTDTAACCGGE

SEQ ID NO: 2175 - protein, 157 aa, Unknown
  Description of Unknown: uncultivated organism with predicted taxonomy: Coraliomargarita sp. CAG:312
  MG2-38 RuvC-III domain
TQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLP

SEQ ID NO: 2176 - protein, 202 aa, Unknown
  Description of Unknown: uncultivated organism with predicted taxonomy: Verrucomicrobia bacterium
  MG2-39 RuvC-III domain
TQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLP

SEQ ID NO: 2177 - protein, 157 aa, Unknown; identical to SEQ ID NO: 2173
  Description of Unknown: uncultivated organism with predicted taxonomy: Coraliomargarita sp. CAG:312
  MG2-40 RuvC-III domain

SEQ ID NO: 2178 - protein, 202 aa, Unknown; identical to SEQ ID NO: 2176
  Description of Unknown: uncultivated organism with predicted taxonomy: Coraliomargarita sp. CAG:312
  MG2-41 RuvC-III domain

SEQ ID NO: 2179 - protein, 202 aa, Unknown; identical to SEQ ID NO: 2176
  Description of Unknown: uncultivated organism with predicted taxonomy: Coraliomargarita sp. CAG:312
  MG2-42 RuvC-III domain

SEQ ID NO: 2180 - protein, 202 aa, Unknown; identical to SEQ ID NO: 2176
  Description of Unknown: uncultivated organism with predicted taxonomy: Verrucomicrobia
  MG2-43 RuvC-III domain

SEQ ID NO: 2181 - protein, 157 aa, Unknown; identical to SEQ ID NO: 2173
  Description of Unknown: uncultivated organism with predicted taxonomy: Coraliomargarita sp. CAG:312
  MG2-44 RuvC-III domain

SEQ ID NO: 2182 - protein, 202 aa, Unknown; identical to SEQ ID NO: 2176
  Description of Unknown: uncultivated organism with predicted taxonomy: Coraliomargarita sp. CAG:312
  MG2-45 RuvC-III domain

SEQ ID NO: 2183 - protein, 157 aa, Unknown; identical to SEQ ID NO: 2173
  Description of Unknown: uncultivated organism with predicted taxonomy: Coraliomargarita sp. CAG:312
  MG2-46 RuvC-III domain

SEQ ID NO: 2184 - protein, 202 aa, Unknown; identical to SEQ ID NO: 2176
  Description of Unknown: uncultivated organism with predicted taxonomy: Verrucomicrobia bacterium
  MG2-47 RuvC-III domain

SEQ ID NO: 2185 - protein, 157 aa, Unknown; identical to SEQ ID NO: 2173
  Description of Unknown: uncultivated organism with predicted taxonomy: Coraliomargarita sp. CAG:312
  MG2-48 RuvC-III domain

SEQ ID NO: 2186 - protein, 202 aa, Unknown; identical to SEQ ID NO: 2176
  Description of Unknown: uncultivated organism with predicted taxonomy: Coraliomargarita sp. CAG:312
  MG2-49 RuvC-III domain

SEQ ID NO: 2187 - protein, 157 aa, Unknown; identical to SEQ ID NO: 2173
  Description of Unknown: uncultivated organism with predicted taxonomy: Coraliomargarita sp. CAG:312
  MG2-50 RuvC-III domain

SEQ ID NO: 2188 - protein, 157 aa, Unknown; identical to SEQ ID NO: 2173
  Description of Unknown: uncultivated organism with predicted taxonomy: Coraliomargarita sp. CAG:312
  MG2-51 RuvC-III domain

SEQ ID NO: 2189 - protein, 202 aa, Unknown; identical to SEQ ID NO: 2176
  Description of Unknown: uncultivated organism with predicted taxonomy: Verrucomicrobia bacterium
  MG2-52 RuvC-III domain

SEQ ID NO: 2190 - protein, 202 aa, Unknown; identical to SEQ ID NO: 2176
  Description of Unknown: uncultivated organism with predicted taxonomy: Verrucomicrobia bacterium
  MG2-53 RuvC-III domain

SEQ ID NO: 2191 - protein, 135 aa, Unknown
  Description of Unknown: uncultivated organism with predicted taxonomy: Coraliomargarita sp. CAG:312
  MG2-54 RuvC-III domain
TQTSHLNKLAFKLVKSLYVDAGKTPELVHLPGSVTSAVRKNWELLPCMGDVCPEIYETLENGDKVLLLKDKIRSITHLHHAVDAVAMGLAASVFPRTKRFYEAVSKRHLSEADREELLNTGLVLFSDDKWKLVEL

SEQ ID NO: 2192 - protein, 157 aa, Unknown; identical to SEQ ID NO: 2175
  Description of Unknown: uncultivated organism with predicted taxonomy: Coraliomargarita sp. CAG:312
  MG2-55 RuvC-III domain

SEQ ID NO: 2193 - protein, 157 aa, Unknown
  Description of Unknown: uncultivated organism with predicted taxonomy: Coraliomargarita sp. CAG:312
  MG2-56 RuvC-III domain
TQTSHLNKLAFKVVKSLYADAEKAPELIHVPGIVTSVVRKNWNLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLP

SEQ ID NO: 2194 - protein, 202 aa, Unknown; identical to SEQ ID NO: 2176
  Description of Unknown: uncultivated organism with predicted taxonomy: Coraliomargarita sp. CAG:312
  MG2-57 RuvC-III domain

SEQ ID NO: 2195 - protein, 202 aa, Unknown; identical to SEQ ID NO: 2176
  Description of Unknown: uncultivated organism with predicted taxonomy: Verrucomicrobia bacterium
  MG2-58 RuvC-III domain

SEQ ID NO: 2196 - protein, 157 aa, Unknown; identical to SEQ ID NO: 2175
  Description of Unknown: uncultivated organism with predicted taxonomy: Coraliomargarita sp. CAG:312
  MG2-59 RuvC-III domain

SEQ ID NO: 2197 - protein, 157 aa, Unknown; identical to SEQ ID NO: 2173
  Description of Unknown: uncultivated organism with predicted taxonomy: Coraliomargarita sp. CAG:312
  MG2-60 RuvC-III domain

SEQ ID NO: 2198 - protein, 157 aa, Unknown; identical to SEQ ID NO: 2173
  Description of Unknown: uncultivated organism with predicted taxonomy: Coraliomargarita sp. CAG:312
  MG2-61 RuvC-III domain

SEQ ID NO: 2199 - protein, 155 aa, Unknown
  Description of Unknown: uncultivated organism with predicted taxonomy: Verrucomicrobia
  MG2-62 RuvC-III domain
TQTSHLNKLAIRLVKRELGIDARHLAGAVTGFVRKNLSIDECLVAAVPRMQRAQRVSEHDSRKLLKSQMRELSHLHHAMDAITQGLTGILFRVEDWKLLVKRHLTERERAVLAAKYPTLLRFSANGEIALKPLPDSLLSEITARLKECRVVQHVP

SEQ ID NO: 2200 - protein, 157 aa, Unknown; identical to SEQ ID NO: 2173
  Description of Unknown: uncultivated organism with predicted taxonomy: Coraliomargarita sp. CAG:312
  MG2-63 RuvC-III domain

SEQ ID NO: 2201 - protein, 157 aa, Unknown; identical to SEQ ID NO: 2173
  Description of Unknown: uncultivated organism with predicted taxonomy: Coraliomargarita sp. CAG:312
  MG2-64 RuvC-III domain

SEQ ID NO: 2202 - protein, 202 aa, Unknown; identical to SEQ ID NO: 2176
  Description of Unknown: uncultivated organism with predicted taxonomy: Coraliomargarita sp. CAG:312
  MG2-65 RuvC-III domain

SEQ ID NO: 2203 - protein, 157 aa, Unknown; identical to SEQ ID NO: 2175
  Description of Unknown: uncultivated organism with predicted taxonomy: Coraliomargarita sp. CAG:312
  MG2-66 RuvC-III domain

SEQ ID NO: 2204 - protein, 157 aa, Unknown; identical to SEQ ID NO: 2173
  Description of Unknown: uncultivated organism with predicted taxonomy: Coraliomargarita sp. CAG:312
  MG2-67 RuvC-III domain

SEQ ID NO: 2205 - protein, 157 aa, Unknown; identical to SEQ ID NO: 2173
  Description of Unknown: uncultivated organism with predicted taxonomy: Coraliomargarita sp. CAG:312
  MG2-68 RuvC-III domain

SEQ ID NO: 2206 - protein, 157 aa, Unknown; identical to SEQ ID NO: 2173
  Description of Unknown: uncultivated organism with predicted taxonomy: Coraliomargarita sp. CAG:312
  MG2-69 RuvC-III domain

SEQ ID NO: 2207 - protein, 157 aa, Unknown; identical to SEQ ID NO: 2173
  Description of Unknown: uncultivated organism with predicted taxonomy: Coraliomargarita sp. CAG:312
  MG2-70 RuvC-III domain

SEQ ID NO: 2208 - protein, 157 aa, Unknown; identical to SEQ ID NO: 2173
  Description of Unknown: uncultivated organism with predicted taxonomy: Coraliomargarita sp. CAG:312
  MG2-71 RuvC-III domain

SEQ ID NO: 2209 - protein, 157 aa, Unknown; identical to SEQ ID NO: 2173
  Description of Unknown: uncultivated organism with predicted taxonomy: Coraliomargarita sp. CAG:312
  MG2-72 RuvC-III domain

SEQ ID NO: 2210 - protein, 202 aa, Unknown; identical to SEQ ID NO: 2176
  Description of Unknown: uncultivated organism with predicted taxonomy: Verrucomicrobia bacterium
  MG2-73 RuvC-III domain

SEQ ID NO: 2211 - protein, 155 aa, Unknown; identical to SEQ ID NO: 2199
  Description of Unknown: uncultivated organism with predicted taxonomy: Verrucomicrobia
  MG2-74 RuvC-III domain

SEQ ID NO: 2212 - protein, 157 aa, Unknown; identical to SEQ ID NO: 2173
  Description of Unknown: uncultivated organism with predicted taxonomy: Coraliomargarita sp. CAG:312
  MG2-75 RuvC-III domain

SEQ ID NO: 2213 - protein, 136 aa, Unknown
  Description of Unknown: uncultivated organism with predicted taxonomy: Verrucomicrobia bacterium
  MG2-76 RuvC-III domain
TVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPDR

SEQ ID NO: 2214 - protein, 154 aa, Unknown
  Description of Unknown: uncultivated organism
  MG2-77 RuvC-III domain
TVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIP

SEQ ID NO: 2215 - protein, 154 aa, Unknown; identical to SEQ ID NO: 2214
  Description of Unknown: uncultivated organism with predicted taxonomy: Verrucomicrobia bacterium
  MG2-78 RuvC-III domain

SEQ ID NO: 2216 - protein, 154 aa, Unknown
  Description of Unknown: uncultivated organism with predicted taxonomy: Verrucomicrobia bacterium
  MG2-79 RuvC-III domain
TQTSQLVRLGGQVLKRAFANSEEKPTLVSLPGSVTGAVRKAWKVLGCLSLANQQVLDENGDVKTKTDIRDITHLHHALDACVLGLTSHFIPNNGRVWELIVKRNPNDLERQQLMALGVFGFNAEKRFEMRDLDNKLKEQIRQRLAEKRVVQHIP

SEQ ID NO: 2217 - protein, 154 aa, Unknown; identical to SEQ ID NO: 2214
  Description of Unknown: uncultivated organism with predicted taxonomy: Verrucomicrobia bacterium
  MG2-80 RuvC-III domain

SEQ ID NO: 2218 - protein, 110 aa, Unknown
  Description of Unknown: uncultivated organism with predicted taxonomy: Verrucomicrobia bacterium
  MG2-81 RuvC-III domain
TVTSQLVRLGAQIIKKTFAGSEKPPMVVSLPGSVTGTVRKGWNLLGCLELAAPQVKEADGGIKNKTDIRDVTHLHHALDACVLGLASYYLPNNGGLWEVMIKRNPNDGEK

SEQ ID NO: 2219 - protein, 154 aa, Unknown
  Description of Unknown: uncultivated organism with predicted taxonomy: Verrucomicrobia bacterium
  MG2-82 RuvC-III domain
TVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLKDLKPERKEQIRQRLAERRVVQHIP

SEQ ID NO: 2220 - protein, 157 aa, Unknown
  Description of Unknown: uncultivated organism
  MG2-83 RuvC-III domain
TQTSQLVRLGAQVLKKNLPHLTTGDVTSLPGSVTGTVRKGWKLEACLGLANPQVFDGNGGAKTKTEIRDITHLHHALDACVLGIAANYFQNQKLGASSLWELLIKRKYNEQEKTILRALGIFQFDKEGNSQIKELPKEIREQIRQRLAEKRVVQHIP

SEQ ID NO: 2221 - protein, 154 aa, Unknown; identical to SEQ ID NO: 2146
  Description of Unknown: uncultivated organism with predicted taxonomy: Verrucomicrobia bacterium
  MG2-84 RuvC-III domain

SEQ ID NO: 2222 - protein, 154 aa, Unknown; identical to SEQ ID NO: 2214
  Description of Unknown: uncultivated organism with predicted taxonomy: Verrucomicrobia bacterium
  MG2-85 RuvC-III domain

SEQ ID NO: 2223 - protein, 154 aa, Unknown; identical to SEQ ID NO: 2146
  Description of Unknown: uncultivated organism
  MG2-86 RuvC-III domain

SEQ ID NO: 2224 - protein, 154 aa, Unknown; identical to SEQ ID NO: 2146
  Description of Unknown: uncultivated organism with predicted taxonomy: Methylococcales bacterium
  MG2-87 RuvC-III domain

SEQ ID NO: 2225 - protein, 154 aa, Unknown; identical to SEQ ID NO: 2146
  Description of Unknown: uncultivated organism
  MG2-88 RuvC-III domain

SEQ ID NO: 2226 - protein, 154 aa, Unknown; identical to SEQ ID NO: 2146
  Description of Unknown: uncultivated organism with predicted taxonomy: Verrucomicrobia
  MG2-89 RuvC-III domain

SEQ ID NO: 2227 - protein, 72 aa, Unknown
  Description of Unknown: uncultivated organism with predicted taxonomy: Verrucomicrobia bacterium
  MG2-90 RuvC-III domain
TQTSQLVRLGAQVLKKNLPHLTTGDVTSLPGSVTGTVRKGWKLEACLGLANPQVFDGNGGAKTKTEIRDITH

SEQ ID NO: 2228 - protein, 157 aa, Unknown; identical to SEQ ID NO: 2220
  Description of Unknown: uncultivated organism
  MG2-91 RuvC-III domain

SEQ ID NO: 2229 - protein, 54 aa, Unknown
  Description of Unknown: uncultivated organism with predicted taxonomy: Verrucomicrobiae bacterium Tous-C5FEB
  MG2-92 RuvC-III domain
TVTSQLVRLGAQIIKKTFAENEKLPTVVSLPGSVTGTVRKGWNLLGCLATAAPQ

SEQ ID NO: 2230 - protein, 174 aa, Unknown
  Description of Unknown: uncultivated organism
  MG2-94 RuvC-III domain
TQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSERRLLKSRYPYLVFTENSRMDIQDLPDATLKTISGRLAECRVVRHIP

SEQ ID NO: 2231 - protein, 174 aa, Unknown; identical to SEQ ID NO: 2230
  Description of Unknown: uncultivated organism
  MG2-95 RuvC-III domain

SEQ ID NO: 2232 - protein, 174 aa, Unknown; identical to SEQ ID NO: 2142
  Description of Unknown: uncultivated organism
  MG2-96 RuvC-III domain

SEQ ID NO: 2233 - protein, 173 aa, Unknown
  Description of Unknown: uncultivated organism with predicted taxonomy: Acidobacteria bacterium RIFCSPLOWO2_12_FULL_68_19
  MG2-97 RuvC-III domain
TQTSHLNKMAISLVKQRIGIDAKHLPGSVTAFIRQKLHIDECLFTAVPRLQKTAKGEGKRPKRKNADEVTAEPMQSDMPPRKLTKADIRELTHLHHAMDAVTQGLALLLFAPEDWPLLVKRNLTDSERRLLKSRYPYLVFTENSRMEIQDLPEATLKTISDRLAECRVIRHIP

SEQ ID NO: 2234 - protein, 154 aa, Unknown
  Description of Unknown: uncultivated organism with predicted taxonomy: Verrucomicrobia bacterium
  MG2-98 RuvC-III domain
TITSQLVRLGARTLEKAFTDGNHAPKIVSMPGSVTGRVQRAWSLMGCIAKANPSVLDENGKPKPKGDIRDISHLHHAVDACVLGIAGTLFPNDGSLWKAMAARSPARAEAEQLLATGLYERDSEKHLRLRDLPAALKNQIADRLSERRVYQHVS

SEQ ID NO: 2235 - protein, 174 aa, Unknown; identical to SEQ ID NO: 2142
  Description of Unknown: uncultivated organism
  MG2-99 RuvC-III domain

SEQ ID NO: 2236 - protein, 174 aa, Unknown; identical to SEQ ID NO: 2230
  Description of Unknown: uncultivated organism with predicted taxonomy: Proteobacteria
  MG2-100 RuvC-III domain

SEQ ID NO: 2237 - protein, 174 aa, Unknown
  Description of Unknown: uncultivated organism with predicted taxonomy: Bradyrhizobium
  MG2-101 RuvC-III domain
TQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSEKRLLKARYPFLLFNGDNNISIQDLPEAALQTISDRLAECRVVRHIP

SEQ ID NO: 2238 - protein, 154 aa, Unknown
  Description of Unknown: uncultivated organism with predicted taxonomy: Methylococcales bacterium
  MG2-102 RuvC-III domain
TQTSQLVRLGAQVLKRVFANSEKKSPVVSLPGSVTGAVRKAWKVLGCLSLANQQVLDENGDVKTKTDIRDITHLHHALDACVLGLTSHFIPNNGRVWELIVKRNPNELEKRELMALGVFGFNAEKRFEMRDLDNKLKEQIRQRLAEKRVVQHIP

SEQ ID NO: 2239 - protein, 153 aa, Unknown
  Description of Unknown: uncultivated organism with predicted taxonomy: Verrucomicrobia bacterium
  MG2-103 RuvC-III domain
TQTSQLVRLGAQVLRNVLPHLKQNDVISLPGSVTGTVRKAWKVLGCLSLANPQVLDENGDVKTKTDIRDITHLHHALDACVLGLVSHFIPNSGQVWELIVKRNPNDTEKKQLTALGVFGFGKDNRFEMRDLDDRLKEQIRQRLAEKRVVQHVP

SEQ ID NO: 2240 - protein, 158 aa, Unknown
  Description of Unknown: uncultivated organism with predicted taxonomy: Verrucomicrobia bacterium
  MG2-104 RuvC-III domain
TVTSHLVRLGAQVLKRHFSDLPREHRIQLEPVSLPGSVTGEIRKAWKLIGCLAVANPQVLNPDGTVKPKQDIRGITHLHHALDACVLGLAAFYFPRHGSLWAAMVKRRPSAEEAALLRQTGFYQTDSEGRFRLIDFPEVLAQQIRQRLAEKRVVQHVP

SEQ ID NO: 2241 - protein, 158 aa, Unknown; identical to SEQ ID NO: 2240
  Description of Unknown: uncultivated organism with predicted taxonomy: Verrucomicrobia bacterium
  MG2-105 RuvC-III domain

SEQ ID NO: 2242 - protein, 163 aa, Unknown
  Description of Unknown: uncultivated organism with predicted taxonomy: Rothia
  MG3-6 RuvC-III domain
ASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRP

SEQ ID NO: 2243 - protein, 159 aa, Unknown
  Description of Unknown: uncultivated organism with predicted taxonomy: Rothia
  MG3-7 RuvC-III domain
ASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVSPLRLRP

SEQ ID NO: 2244 - protein, 163 aa, Unknown
  Description of Unknown: uncultivated organism with predicted taxonomy: Rothia
  MG3-8 RuvC-III domain
ASTSYAAVAVRERLEQHFNEGLAPDDKNRVVLDVYAGSVTRESRRAGGIDERILLRGERDKNRFDVRHHAIDAAVMTLLNRSVALTLEQRSQLRRAFYEQGLDKLDRDQLKPEEDWRNFIGLSLASQEKFLEWKKVTTVLGDLLAEAIEDDSIAVVSPLRLRP

SEQ ID NO: 2245 - protein, 145 aa, Unknown
  Description of Unknown: uncultivated organism with predicted taxonomy: Dermabacter hominis
  MG3-1 RuvC-III domain
ASTSYAATEITRRILGHFHDEVPVVAFGGSGTREARRAGRVDHIIRLRGSLDKSRLDTRHHAIDAAVLTLQSPAIYRVLLTRVNLKHEHEVTGEAPEWRDYEGADQAEKVLYRRWQKNIATLAELMRQEIENNRVPVTRPIRLRK

SEQ ID NO: 2246 - protein, 148 aa, Unknown
  Description of Unknown: uncultivated organism with predicted taxonomy: Micrococcales
  MG3-5 RuvC-III domain
SATAFAAVEIRRKLENHFKDRTKPVRVDVYRGALTRESRRAGRIDAKIRLRGNIDKDRLDIRHHAIDAAVLTLLDPSVAKTLAMRLDLKREQQDSGRDTRWKEFKGLTPASQERFIKWCQASECLADMLRQQIEADRVPVVVPLRISP

SEQ ID NO: 2247 - protein, 156 aa, Unknown
  Description of Unknown: uncultivated organism with predicted taxonomy: Rothia
  MG3-6 RuvC-III domain
ASTSYAATSIRERLEQHFNDDLPDGFAPVAVDVYGGSLTRESRRAGGIDKSIMLRGQSDKNRFDVRHHAIDAAVMTLLNPSVAVTLEQRRMLKQENDYSSPRGQHDNGWRDFIGRGEASQSKFLHWKKTAVVLADLISEAIEQDTIPVVNPLRLRP

SEQ ID NO: 2248 - protein, 163 aa, Unknown
  Description of Unknown: uncultivated organism with predicted taxonomy: Rothia
  MG3-7 RuvC-III domain
ASTSYAAVAVRERLEQHFNEGLAPDDKSRVVLDVYAGAVTRESRRAGGIDERILLRGERDKNRFDVRHHAIDAAVMTLLNRSVALTLEQRSQLRRAFYELELDKLDRDQLKPGEDWRNFTGLYEASQNKFSEWKKAATVLGDLLAEAIEDDAIAVVSPLRLRP

SEQ ID NO: 2249 - protein, 163 aa, Unknown; identical to SEQ ID NO: 2244
  Description of Unknown: uncultivated organism with predicted taxonomy: Rothia
  MG3-8 RuvC-III domain

SEQ ID NO: 2250 - protein, 152 aa, Unknown
  Description of Unknown: uncultivated organism with predicted taxonomy: Brevibacterium
  MG3-42 RuvC-III domain
ESTAYAATEIRRRLQYYFEENCGANSPQPEILVLPGAVTREARRAGGFDSRIKLRGKNDKDRFDARHHALDAAIMTVVDRSVARTLQQRSDLKYSNFLTGAEPRWKDFKGDSPESRKKFERWVQTSNRLADLVSDAIVTDSIPVIFPLRLGT

SEQ ID NO: 2251 - protein, 144 aa, Unknown
  Description of Unknown: uncultivated organism with predicted taxonomy: Brevibacterium mcbrellneri
  MG3-68 RuvC-III domain
ESTAYAATEIRRRVQYYFEENCGANVPQPEIFVLPGAVTREARRAGGFDSRIKLRGKGDKDRFDARHHALDAAIMTVVDWSVARTLQQRSDLKYSNFLTGAEPRWKEFKGDSPEARKKFERWIQTSNRLADLVSDAIVAAAIPV

SEQ ID NO: 2252 - protein, 152 aa, Unknown; identical to SEQ ID NO: 2250
  Description of Unknown: uncultivated organism with predicted taxonomy: Brevibacterium mcbrellneri
  MG3-88 RuvC-III domain

SEQ ID NO: 2253 - protein, 131 aa, Unknown
  Description of Unknown: uncultivated organism with predicted taxonomy: Planctomycetes
  MG4-5 RuvC-III domain
NDTRYASRLAADYLALLYGGRVDANGRQRVQVGTGATTGFLRDEWGLNAILGDNDEKERADHRHHAIDAVVIALTGPGTVQALTRAALRAKELGRRLFVPLDPPWADRDSFLRDVRASVEAITVSYRVDRK

SEQ ID NO: 2254 - protein, 121 aa, Unknown
  Description of Unknown: uncultivated organism
  MG4-11 RuvC-III domain
TDTSYISKKAVEYVSLLFGGSIDAKGKRRVFATKGGITGRLRREWGLNVLLGGEDEKNRADHRHHAIDALVIALSTPAVIKKIGGEDTRPKEDILPPIDNLADVAREVLEKVNVVYRCSQK

SEQ ID NO: 2255 - protein, 148 aa, Unknown
  Description of Unknown: uncultivated organism
  MG4-12 RuvC-III domain
NDSRYMSKLALRYLGVLYGAVNGCVGGQDEDEGGKRVIFASTGKVTAWIRREWRLNEILCDDDEPTGEGADVEKNRNDHRHHAIDALVISLSTPSYVQQLNRAAQLADNDAKARLFKKGNFMPPVTGFKALVAQVVDGIVVSKRVDSK

SEQ ID NO: 2256 - protein, 134 aa, Unknown
  Description of Unknown: uncultivated organism
  MG4-13 RuvC-III domain
NDTKYASKLAKKFLGLLYPGQEALSRVQATKGGITANLRDVFNLNSILKDGDSVERDGYEPKKTRADHRHHAIDAICIALTEPSTVKMLSEASSRALKERKRRFGKVQPPWENFWEDVKKAIDNTIVSHRVSKK

SEQ ID NO: 2257 - protein, 130 aa, Unknown
  Description of Unknown: uncultivated organism
  MG4-14 RuvC-III domain
NDTAHASRSALRYLGLLYGSNKAGVGPDGRRRVQAGRGQVTAFLRDEWRLNSILGDLQKSRADHRHHAVDALAIALTDSRIIKTLSDAASRALSERRRRFGRVAPPWKSFLEEAKNAIAATIVSHRVSRK

SEQ ID NO: 2258 - protein, 128 aa, Unknown
  Description of Unknown: uncultivated organism with predicted taxonomy: Thermogutta terrifontis
  MG4-15 RuvC-III domain
SDTRWISKAAADYLGHLYGGRIDPTGQQRVFTVAGGLTGLFRRAWNLNAILGGSPEKNRYDHRHHAIDAIVVALTDPSMIQRFAHEASRLLKAWPRVAVRLDPPWSTFLSDVQRHVEGIVVSFRVSRR

SEQ ID NO: 2259 - protein, 128 aa, Unknown; identical to SEQ ID NO: 2258
  Description of Unknown: uncultivated organism with predicted taxonomy: Thermogutta terrifontis
  MG4-16 RuvC-III domain

SEQ ID NO: 2260 - protein, 128 aa, Unknown
  Description of Unknown: uncultivated organism with predicted taxonomy: Thermogutta terrifontis
  MG4-17 RuvC-III domain
NDTRWISKAAADYFGYLYGGRIAPTGQQRVFTVTGGLTALFRRAWNLNAVLGGNPEKNRYDHRHHAIDAIVVALTEPSMIQRFSNEAEKLIKAFPRVAVRLDPPWDTFLSDVQQHVERIVVSFRVNRR

SEQ ID NO: 2261 - protein, 128 aa, Unknown
  Description of Unknown: uncultivated organism with predicted taxonomy: Thermogutta terrifontis
  MG4-18 RuvC-III domain
SDTRWISKAAADYLGHLYGGRIDPTGQQRVFTVAGGLTGLFRRAWNLNAILGGSPEKNRYDHRHHAIDAIVVALTEPSMIQRFAHEASRLLKAWPRVAVRLDPPWSTFLSDVQRHVEGIVVSFRVSRR

SEQ ID NO: 2262 - protein, 141 aa, Unknown
  Description of Unknown: uncultivated organism
  MG4-19 RuvC-III domain
NDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHR

SEQ ID NO: 2263 - protein, 141 aa, Unknown; identical to SEQ ID NO: 2262
  Description of Unknown: uncultivated organism
  MG4-20 RuvC-III domain

SEQ ID NO: 2264 - protein, 141 aa, Unknown; identical to SEQ ID NO: 2262
  Description of Unknown: uncultivated organism
  MG4-21 RuvC-III domain

SEQ ID NO: 2265 - protein, 141 aa, Unknown
  Description of Unknown: uncultivated organism with predicted taxonomy: Planctomyces sp. SH-PL14
  MG4-22 RuvC-III domain
NDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGIVDSIRPHFEQMLVSHRPEHR

SEQ ID NO: 2266 - protein, 141 aa, Unknown; identical to SEQ ID NO: 2262
  Description of Unknown: uncultivated organism
  MG4-23 RuvC-III domain

SEQ ID NO: 2267 - protein, 141 aa, Unknown; identical to SEQ ID NO: 2262
  Description of Unknown: uncultivated organism
  MG4-24 RuvC-III domain

SEQ ID NO: 2268 - protein, 141 aa, Unknown; identical to SEQ ID NO: 2262
  Description of Unknown: uncultivated organism
  MG4-25 RuvC-III domain

SEQ ID NO: 2269 - protein, 141 aa, Unknown; identical to SEQ ID NO: 2262
  Description of Unknown: uncultivated organism
  MG4-26 RuvC-III domain

SEQ ID NO: 2270 - protein, 141 aa, Unknown; identical to SEQ ID NO: 2262
  Description of Unknown: uncultivated organism
  MG4-27 RuvC-III domain

SEQ ID NO: 2271 - protein, 141 aa, Unknown; identical to SEQ ID NO: 2262
  Description of Unknown: uncultivated organism
  MG4-28 RuvC-III domain

SEQ ID NO: 2272 - protein, 141 aa, Unknown; identical to SEQ ID NO: 2262
  Description of Unknown: uncultivated organism
  MG4-29 RuvC-III domain

SEQ ID NO: 2273 - protein, 134 aa, Unknown
  Description of Unknown: uncultivated organism with predicted taxonomy: Alphaproteobacteria bacterium
  MG4-30 RuvC-III domain
NDTAYASRLAADYLGILYGGRTDREHRLRVQATAGQATARLRARWNLDSILDDGPTKHGGRASKERTDHRHHAIDAVVIGVTDQGMMERLSDAAKRGQEVGKRFARLDEPWNGFLEQVRKEVGQIVVSHRVSKK

SEQ ID NO: 2274 - protein, 131 aa, Unknown
  Description of Unknown: uncultivated organism
  MG4-31 RuvC-III domain
NDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQAKVAVDKIVVSYRPDRK

SEQ ID NO: 2275 - protein, 133 aa, Unknown
  Description of Unknown: uncultivated organism
  MG4-32 RuvC-III domain
QETRYIGRLACDYLGLLYGGQVEAQGTAVSERRILTPTGGLVAWLRRGWGLNSVLSDRDEKERNDHRHHAVDAIVIACADQRAIQRLSESAERMEREGRERPYESVDPPWEGFEQSVQEAIHAVVVSHRQSRK

SEQ ID NO: 2276 - protein, 115 aa, Unknown
  Description of Unknown: uncultivated organism with predicted taxonomy: Insolitispirillum peregrinum
  MG4-33 RuvC-III domain
NDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQA

SEQ ID NO: 2277 - protein, 129 aa, Unknown
  Description of Unknown: uncultivated organism with predicted taxonomy: Planctomycetes bacterium
  MG4-34 RuvC-III domain
NDTRYMSRVACEYLGALYGGLSDEYHRRRVQSTTGGLTFELRRGWSLNSILGIGDEKNRADHRHHAVDAIVVALTGPKAIQQASRAAQRAETRGGARLFEEFEDPWPGFRDDVKAIVKSIVVSHRQSRK

SEQ ID NO: 2278 - protein, 133 aa, Unknown; identical to SEQ ID NO: 2275
  Description of Unknown: uncultivated organism
  MG4-35 RuvC-III domain

SEQ ID NO: 2279 - protein, 143 aa, Unknown
  Description of Unknown: uncultivated organism with predicted taxonomy: Proteobacteria
  MG4-36 RuvC-III domain
NDTRAASVAAARYLALLYGGEIVDGKRKILKITGQVTAYLRDVWGLNGLIPSIHREARGEAADAEAESRTLKSRDDHRHHAVDAVVVALCNQRWIQRLSEANRGALAARRRWFAPVEPPWVGFKEQLKDTLKSMNISFRPDHR

SEQ ID NO: 2280 - protein, 76 aa, Unknown
  Description of Unknown: uncultivated organism with predicted taxonomy: Solemya velesiana gill symbiont
  MG4-37 RuvC-III domain
NDTRASAVAAARYLSLLYGGETVDGKRKILKVTGQVTAYLRDVWGLNGLIPSIHREARGEAEDGQAEARPVKSRDD

SEQ ID NO: 2281 - protein, 127 aa, Unknown
  Description of Unknown: uncultivated organism with predicted taxonomy: Acidobacteria
  MG4-38 RuvC-III domain
NDTRYAAVVAGRYLSLLYGGEVIDGKRKILKVTGQITAHLRRVWGMNEILGRAGVKSRDDHRQHAIDAALVAVADQRSVQRLSQAAARAELQHRRRLPALEPPFVGFKEGLQCLVQTMNISFRPDHR

SEQ ID NO: 2282 - protein, 89 aa, Unknown
  Description of Unknown: uncultivated organism with predicted taxonomy: Planctomycetes
  MG4-39 RuvC-III domain
NDTRYSSRLASEYLSLLYGGRSDAQGNLRVQASTGAVTSLLRDQWGLNAILAELGRQLGVSGLDDDVEKARFDHRHHAVDALVIALTTP

SEQ ID NO: 2283 - protein, 127 aa, Unknown
  Description of Unknown: uncultivated organism with predicted taxonomy: Thermogutta terrifontis
  MG4-40 RuvC-III domain
SDTRWISRTAADYLGLLYGGRIDPTGKQRIQTTAGRLTALLRRAWDLDSILGPGTEKNRADHRQHAIDAVVIALTDPAVVHRLSRWASHRPSWVRITPQLDSPWPGFFDQVKHRILSILVSFRQHRR

SEQ ID NO: 2284 - protein, 116 aa, Unknown
  Description of Unknown: uncultivated organism with predicted taxonomy: Planctomycetes
  MG4-41 RuvC-III domain
NDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPP

SEQ ID NO: 2285 - protein, 127 aa, Unknown; identical to SEQ ID NO: 2283
  Description of Unknown: uncultivated organism with predicted taxonomy: Thermogutta terrifontis
  MG4-42 RuvC-III domain

SEQ ID NO: 2286 - protein, 127 aa, Unknown; identical to SEQ ID NO: 2283
  Description of Unknown: uncultivated organism
  MG4-43 RuvC-III domain

SEQ ID NO: 2287 - protein, 132 aa, Unknown
  Description of Unknown: uncultivated organism with predicted taxonomy: Proteobacteria
  MG4-44 RuvC-III domain
NDTRHAAKVAMGYLGLLYPKEERLKRVKAFAGGVTGELRKCWKLNSILGDPDSVEPKKNRADHRHHAIDALVLALATPGMVQYLSKAAAQQLACQRSIRGYQKFMEDPWPHFLEDVRKAVNAIVVSHRVDHR

SEQ ID NO: 2288 - protein, 132 aa, Unknown; identical to SEQ ID NO: 2287
  Description of Unknown: uncultivated organism
  MG4-45 RuvC-III domain

SEQ ID NO: 2289 - protein, 127 aa, Unknown; identical to SEQ ID NO: 2283
  Description of Unknown: uncultivated organism
  MG4-46 RuvC-III domain

SEQ ID NO: 2290 - protein, 143 aa, Unknown
  Description of Unknown: uncultivated organism with predicted taxonomy: Proteobacteria
  MG4-47 RuvC-III domain
NDTRASAVAAARYLSLLYGGETVDGKRKILKVTGQVTAYLRDVWGLNGLIPSIHREARGEAEDRQAEARPVKSRDDHRHHAVDAVVVALCNQGWIQRLSEANRGALAARRRLFAPVEPPWVGFKEQLKDILKSMNISFRPDHR

SEQ ID NO: 2291 - protein, 122 aa, Unknown
  Description of Unknown: uncultivated organism
  MG4-48 RuvC-III domain
HATAYAARVAARELARLYPNQERAHRIWVSSGRATACLRDAWQLNQLLGRKDEKNRADHRHHMVDAVVVALTTPKIVQDLTHAAQNAVRARRFQGMEPPSGLHEALRQRLEKVIVSHRVERK

SEQ ID NO: 2292 - protein, 143 aa, Unknown
  Description of Unknown: uncultivated organism
  MG4-49 RuvC-III domain
NDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPPWGTRAQFVADVRNAVLAINVSRRVDRR

SEQ ID NO: 2293 - protein, 92 aa, Unknown
  Description of Unknown: uncultivated organism with predicted taxonomy: Solemya velesiana gill symbiont
  MG4-51 RuvC-III domain
NDTRAAAVAAARYLALLFGGETVGGKLKILKITGQVTAHLRDAWDLNGLIPSIHRETRGEAADKEPKTPPLKSRDDHRHHAVDAVVVALCDQ

SEQ ID NO: 2294 - protein, 143 aa, Unknown
  Description of Unknown: uncultivated organism
  MG4-52 RuvC-III domain
NDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHR

SEQ ID NO: 2295 - protein, 128 aa, Unknown
  Description of Unknown: uncultivated organism
  MG4-53 RuvC-III domain
NDTRYAARAAAEYLGRLYGGQSDAGHRRRIQVATGQVTAFLRREWGLNAILGDGDEKSRDDHRHHAVDALCVALTDAGIVQALAAAAARAPAEGRRCFARLAPPWPSFLADARRAVLEITVSHRVRRK

SEQ ID NO: 2296 - protein, 127 aa, Unknown; identical to SEQ ID NO: 2281
  Description of Unknown: uncultivated organism
  MG4-54 RuvC-III domain

SEQ ID NO: 2297 - protein, 132 aa, Unknown
  Description of Unknown: uncultivated organism with predicted taxonomy: Flavobacterium hercynium
  MG4-55 RuvC-III domain
NDTRHAAKVAMGYLGLLYPKEERLKRVKAFAGGVTGELRKCWKLNSILGDPDSVEPKKNRADHRHHAIDALVLALATPGMVQYLSKAAEQQLACQRSIRGYQKFMEDPWPHFLEDVRKAVNAIVVSHRVDHR

SEQ ID NO: 2298 - protein, 143 aa, Unknown; identical to SEQ ID NO: 2279
  Description of Unknown: uncultivated organism with predicted taxonomy: Pseudoxanthobacter soli
  MG4-56 RuvC-III domain

SEQ ID NO: 2299 - protein, 128 aa, Unknown
  Description of Unknown: uncultivated organism with predicted taxonomy: candidate division Zixibacteria bacterium CG_4_9_14_3_um_filter_46_8
  MG4-57 RuvC-III domain
NDTRYASVLAAKYLGALYGGAIDAEHTRRIQVSAGMVTAYLRNEYGLNPILGDGGEKSRDDHRHHAIDAICVALTDAATVKMLSDAASRALSERRRQFGHIDPPWPSFLADVRKHIDDLIVSHAVSRK

SEQ ID NO: 2300 - protein, 143 aa, Unknown; identical to SEQ ID NO: 2294
  Description of Unknown: uncultivated organism
  MG4-58 RuvC-III domain

SEQ ID NO: 2301 - protein, 143 aa, Unknown; identical to SEQ ID NO: 2294
  Description of Unknown: uncultivated organism with predicted taxonomy: Proteobacteria
  MG4-60 RuvC-III domain

SEQ ID NO: 2302 - protein, 127 aa, Unknown; identical to SEQ ID NO: 2283
  Description of Unknown: uncultivated organism with predicted taxonomy: Thermogutta terrifontis
  MG4-61 RuvC-III domain

SEQ ID NO: 2303 - protein, 124 aa, Unknown
  Description of Unknown: uncultivated organism
  MG4-62 RuvC-III domain
QDTRYITTLARDFVSLLYGKDASAIVTPSGPLTAWLRRGWHLNSVLGFTDEKEREDHRHHAVDAIVIALATRSNIKRLSDAAERVEREGREKAFGTVDPPWDGFEHEVRSIIDGVVVSHRQSQR

SEQ ID NO: 2304 - protein, 132 aa, Unknown
  Description of Unknown: uncultivated organism with predicted taxonomy: Planctomyces sp. SH-PL14
  MG4-63 RuvC-III domain
SETRYIARQAADYLGLLYGGRIEQRAGDEVGRRRVLVTPGRATALLRNGWQLASVTGGLKNRQDHRHHAIDALIVGLTQDGFLKQLSEAAARADELQLTRLTTEMDSPWETFLDDVGKGYERIHVSTRPTRK

SEQ ID NO: 2305 - protein, 124 aa, Unknown; identical to SEQ ID NO: 2303
  Description of Unknown: uncultivated organism
  MG4-64 RuvC-III domain

SEQ ID NO: 2306 - protein, 128 aa, Unknown
  Description of Unknown: uncultivated organism
  MG4-65 RuvC-III domain
QDTRYACRLAADYLGRLYGGRVDAQGKMRIEVRPGGLTAHVRNELMLHAILDDGGAKTRADHRHHAVDALAVGLTSQSMVQQLQTAAGRALQAGRRLFAPVPEPWTGFLEDARRSIGQIIVSRRPDRK

SEQ ID NO: 2307 - protein, 143 aa, Unknown
  Description of Unknown: uncultivated organism
  MG4-66 RuvC-III domain
NDTRYSSRLAAEYLALLYGGRSDAQGNLRVRAITGAVTAQLRDQWGLNAVLAELGRQLGVRDLDDNVEKARFDHRHHAVDALVIALTTPGMVKRFSDESQRARQYGRQLRCFFDPPWGTRTEFVADVRNAVLAINVSRRLDRR

SEQ ID NO: 2308 - protein, 128 aa, Unknown
  Description of Unknown: uncultivated organism with predicted taxonomy: Proteobacteria
  MG4-67 RuvC-III domain
NDTRYASRLAAEYVGLLYGGRADAEHRQRVYVCTGGTTAFLRNEWKLNTILGDGGPKTRDDHRHHAVDALVIALTGPATVKMLADAADNPWQHRRRLFAPIQEPWVGFLDQAREAILRINVSHRVNRR

SEQ ID NO: 2309 - protein, 127 aa, Unknown
  Description of Unknown: uncultivated organism with predicted taxonomy: Thermogutta terrifontis
  MG4-68 RuvC-III domain
SDTRWITTAAADYLGYLYGGRIDSEGRQRVFTVTGPLTALIRRGWNLDGILGGPEKNRFDYRQHAIDAIVIALIDQAIVQQISLLSSRLWGTDRPTAVQLPEPWPSFYHDAKNAILNIVVSHRISRR

SEQ ID NO: 2310 - protein, 143 aa, Unknown
  Description of Unknown: uncultivated organism with predicted taxonomy: Planctomycetes bacterium
  MG4-70 RuvC-III domain
NDTRAAAVAAARYLALLFGGETVGGKLKILKITGQVTAHLRDAWDLNGLIPSIHRETRGEAADKEPKTPPLKSRDDHRHHAVDAVVVALCDQGSIHRLSEASKTAVAARRRLLAPMAPPWVGFREQLKDILKSMNISFRPDHR

SEQ ID NO: 2311 - protein, 140 aa, Unknown
  Description of Unknown: uncultivated organism
  MG4-71 RuvC-III domain
TDTRYASRLAADYLGLLYGGTVDAAGRRRVQTSSGTATWYLRSEWDMNAVIPGLSGSPTGSASGTFIEKVRTDHRHHAIDAVAIALTSARVVKMLADAARNPEQHRRRRFAPVPPPWPNFKDEVSAAAEKIIVSHRVDRR

SEQ ID NO: 2312 - protein, 135 aa, Unknown
  Description of Unknown: uncultivated organism with predicted taxonomy: Acidobacteria
  MG4-72 RuvC-III domain
NDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAQLEHRRRFASLEAPWPNFVDSVRTEIDRIIVSHRVSKK

SEQ ID NO: 2313 - protein, 85 aa, Unknown
  Description of Unknown: uncultivated organism
  MG4-73 RuvC-III domain
TDTRYASRLAADYLGLLYGGTVDAAGRRRVQTSSGTATWYLRSEWDMNAVIPGLSGSPTGSASGTFIEKVRTDHRHHAIDAVAIA

SEQ ID NO: 2314 - protein, 135 aa, Unknown
  Description of Unknown: uncultivated organism with predicted taxonomy: Acidobacteria
  MG4-74 RuvC-III domain
NDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAQLEHRRRFASLEAPCPNFVDSVRTEIDRIIVSHRVSKK

SEQ ID NO: 2315 - protein, 143 aa, Unknown; identical to SEQ ID NO: 2310
  Description of Unknown: uncultivated organism with predicted taxonomy: Proteobacteria
  MG4-76 RuvC-III domain

SEQ ID NO: 2316 - protein, 142 aa, Unknown
  Description of Unknown: uncultivated organism
  MG4-77 RuvC-III domain
NDTRAAAVAAARYLALLYGGETVDGKRKILKPTGQVTAYLREVWGLNGLIPSIHREAAGAEESDDGRTIRKSRDDHRHHAIDAVAVALCDQGTIQMLSEANRGAAAARRRRFAPVPPPWVGFKDELRQVLRSMNISFRPDHR

SEQ ID NO: 2317 - protein, 122 aa, Unknown
  Description of Unknown: uncultivated organism
  MG4-78 RuvC-III domain
QATAHAARLAGRLLGRWYPAEERLSRIQITNGAVTSWLRVAWGLNQLLGVADEKNRSDHRHHLVDATVIALTTAATVKALTEAARRSARPRRFVDMPVPPGLVDSLRQQLETVIVSHRVDRR

SEQ ID NO: 2318 - protein, 122 aa, Unknown; identical to SEQ ID NO: 2317
  Description of Unknown: uncultivated organism
  MG4-79 RuvC-III domain

SEQ ID NO: 2319 - protein, 132 aa, Unknown
  Description of Unknown: uncultivated organism with predicted taxonomy: Planctomycetes
  MG4-80 RuvC-III domain
NDTRHSTKLAAQYLGLLYGGPYDAQGHRRLVAVSGSITAHLRRAWRLGVHPGPDQAGPGKNRDDHRHHALDAIVVALTSHATIQKLSTFAARSQPGQQRLITGDLQEPWPSFQRDVRQALMAIYVSFRAEHK

SEQ ID NO: 2320 - protein, 127 aa, Unknown
  Description of Unknown: uncultivated organism with predicted taxonomy: Rhodobacteraceae
  MG4-81 RuvC-III domain
NDTRAAAVAAARYLALLYGGETVDGKRKILKPTGQVTAYLREVWGLNGLIPSIHREAAGAEESDDGRTIRKSRDDHRHHAIDAVAVALCDQGTIQMLSEANRGAAAARRRRFAPVPPPWVGFKDELR

SEQ ID NO: 2321 - protein, 135 aa, Unknown
  Description of Unknown: uncultivated organism
  MG4-82 RuvC-III domain
VDTRYMSRAAAEYVGLLYGGAVDSQGTRRVQVSPGGVTADLRRLWGLNRVLPRDPGDDERPGKKSRSDHRHHALDAAVIALTSPAMVQQLSRCAQDALLIGSRRFVALELPFPSLIDDLKKAIDEIVVSYRVKRK

SEQ ID NO: 2322 - protein, 133 aa, Unknown
  Description of Unknown: uncultivated organism
  MG4-83 RuvC-III domain
NDTRYISRLAVQYAGLLYGAGADGVDPSGRRRVQAARGQITAHLRDVYELNSLLGDGGEKYRGDHRHHAVDALCVALTTPRAVKQLSDAAAAGEDRRRAWYDTRLITDPWPGFLDDARNAVNAIVVSHCPSRK

SEQ ID NO: 2323 - protein, 126 aa, Unknown
  Description of Unknown: uncultivated organism
  MG4-84 RuvC-III domain
NDTRYAAVEAMDFLKLLYGEEAQRKVIVQAARGGTTRFLREEFGLNQILGDGGEKSRDDHRHHAVDAICVALTDPATVKMLSDAAARALSEGRRRFASVPFPWGRFLDDVRASIQGINVSFRVSRK

SEQ ID NO: 2324 - protein, 122 aa, Unknown; identical to SEQ ID NO: 2317
  Description of Unknown: uncultivated organism
  MG4-85 RuvC-III domain

SEQ ID NO: 2325 - protein, 122 aa, Unknown; identical to SEQ ID NO: 2317
  Description of Unknown: uncultivated organism
  MG4-86 RuvC-III domain

SEQ ID NO: 2326 - protein, 134 aa, Unknown
  Description of Unknown: uncultivated organism
  MG4-87 RuvC-III domain
SDTRYIARAVSEYLGVLYGGRTDADGKQRIVACSGGLTSWLRREWGLDALLSPTGDDAEAEKNRIDHRHHAVDALVVALTTPRTQAMLQAAAARQEQEGRFRLFGRIEPLWSAFPREAKAAVEAIVVSHRQQRA

SEQ ID NO: 2327 - protein, 121 aa, Unknown
  Description of Unknown: uncultivated organism with predicted taxonomy: Planctomycetes bacterium
  MG4-88 RuvC-III domain
NDTRHNSKVAAEYLGLLYGGLWDASGKRRIEAITGGITALLRNAWRLRKDRADHRHHALDAIVLALVDPAQVKSLQESAERASEGSARFRLGELDEPWPGFRDAVRSALEEINVSIRADRK

SEQ ID NO: 2328 - protein, 61 aa, Unknown
  Description of Unknown: uncultivated organism with predicted taxonomy: Planctomicrobium piriforme
  MG4-89 RuvC-III domain
AETRKIGAASAGFLGLLYGGEIDAAHKRRVFVTTGGLTAHLRREWHLNGILGTEGEKARDD

SEQ ID NO: 2329 - protein, 124 aa, Unknown; identical to SEQ ID NO: 2303
  Description of Unknown: uncultivated organism
  MG4-90 RuvC-III domain

SEQ ID NO: 2330 - protein, 130 aa, Unknown
  Description of Unknown: uncultivated organism with predicted taxonomy: Deltaproteobacteria bacterium
  MG4-91 RuvC-III domain
RETSYFARLAQEYVGLLYGGIVDAEGTRRVIASSGGATHWLRRELGLDSILSDDEEKNRSDHRHHAVDAITTALLDSRTIQLLARAAQEAEERGSRRLFLSLQEEPWQGCRRDVEEAVARINVSHRQRRR

SEQ ID NO: 2331 - protein, 127 aa, Unknown
  Description of Unknown: uncultivated organism with predicted taxonomy: Alphaproteobacteria
  MG4-92 RuvC-III domain
TDTAYAARLARDYLGVLYGAESLRRIQVLPGRLTSLLRGAWQLNRILGDPERNTKSRADHRHHAIDALVAAVTDRSMVQKICTRAKQLEDLKQVRLLPEIDPPWAGLLNDTREALARTIPSSRVDRK

SEQ ID NO: 2332 - protein, 127 aa, Unknown
  Description of Unknown: uncultivated organism with predicted taxonomy: Proteobacteria
  MG4-93 RuvC-III domain
TDTAYAARLARDYLGVLYGAESLRRIQVLPGRLTSLLRGAWQLNRILGDPERNTKSRADHRHHAIDALVAAVTDRSMVQKICTRAKQLEELKQARLLPEIDPPWAGLLNDTREALARTIPSSRADRK

SEQ ID NO: 2333 - protein, 130 aa, Unknown
  Description of Unknown: uncultivated organism with predicted taxonomy: Planctomycetales bacterium 4484_113
  MG4-94 RuvC-III domain
NDTRYGSKLAKKYLGLLYGGVDNDGIDASRKRRVQATIGAVTAKLRDAMGLNAVLGKGAKSRDDHRHHAVDAVVIALTSPGTIKGISDASQHPALTDVRKIKLAEPWQGFLAEVRQAVDRIVVSHRVDRR

SEQ ID NO: 2334 - protein, 126 aa, Unknown
  Description of Unknown: uncultivated organism with predicted taxonomy: Planctomycetes bacterium
  MG4-95 RuvC-III domain
NDTRYASKLAKKYLGLLYGKDAAKHVQAGRGGVTKFIRDELCLNAILGDGGDEKKRTDHRHHAVDAIAIALTSPGVVKMLSDAARYNEEKGLRRRFGNIKSPWPGFFEDVRKAVENIVASHRVSRR

SEQ ID NO: 2335 - protein, 130 aa, Unknown; identical to SEQ ID NO: 2333
  Description of Unknown: uncultivated organism with predicted taxonomy: Planctomycetales bacterium 4484_113
  MG4-96 RuvC-III domain

SEQ ID NO: 2336 - protein, 122 aa, Unknown
  Description of Unknown: uncultivated organism with predicted taxonomy: Planctomycetes bacterium
  MG4-97 RuvC-III domain
NATAYAARYAARHLALLYPQEERRKRVQVSAGRTTAYLRRAWNLNRLIGLADEKNRADYRHHAVDAVVIALTTPKLTGELSKAAARSVRPGTFQGLTPPPGLTRQLEEILDQMVVSHRVDRR

SEQ ID NO: 2337 - protein, 132 aa, Unknown
  Description of Unknown: uncultivated organism
  MG4-98 RuvC-III domain
NDTAWASKWAKKYLGLLYGDIKSKGIDSAGKLRVQAVSGRLTSELRRIWGLNNILGDGNTKSRDDHRHHAIDAIVIALSNPAVVKQLAEASKRAVNIGDKLLKDFPQPWEGFHNDVKRVIDGIIASHRVSKR

SEQ ID NO: 2338 - protein, 126 aa, Unknown; identical to SEQ ID NO: 2334
  Description of Unknown: uncultivated organism with predicted taxonomy: Planctomycetes bacterium
  MG4-99 RuvC-III domain

SEQ ID NO: 2339 - protein, 126 aa, Unknown; identical to SEQ ID NO: 2334
  Description of Unknown: uncultivated organism with predicted taxonomy: Planctomycetes bacterium
  MG4-100 RuvC-III domain

SEQ ID NO: 2340 - protein, 132 aa, Unknown; identical to SEQ ID NO: 2337
  Description of Unknown: uncultivated organism
  MG4-101 RuvC-III domain

SEQ ID NO: 2341 - protein, 134 aa, Unknown
  Description of Unknown: uncultivated organism
  MG4-102 RuvC-III domain
NDTRYAAKEAAAYLGMLYGGSVTSIDGRKRVQVLSGGLTYKVRSAYNLNGILNDGDVKTRNDHRHHAVDAIAIGMTSPGMVKKLTEIAKELENRRDYIRFGTGKGILPDKWNTFDEDVRRVIGKIKVSHKIPRK

SEQ ID NO: 2342 - protein, 134 aa, Unknown; identical to SEQ ID NO: 2341
  Description of Unknown: uncultivated organism
  MG4-103 RuvC-III domain

SEQ ID NO: 2343 - protein, 125 aa, Unknown
  Description of Unknown: uncultivated organism with predicted taxonomy: Planctomycetes bacterium
  MG4-104 RuvC-III domain
NDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINR

SEQ ID NO: 2344 - protein, 125 aa, Unknown; identical to SEQ ID NO: 2343
  Description of Unknown: uncultivated organism
  MG4-105 RuvC-III domain

SEQ ID NO: 2345 - protein, 125 aa, Unknown
  Description of Unknown: uncultivated organism
  MG4-106 RuvC-III domain
NDTRYASKLATEYLALLYGGMNDRNRVQRIQCSAGGCTAVVRRAWGGNYLLGEGEKVRGDHRHHAIDALTIAVTSPAIVKLIAGLKGEDRRRAIEEKRPLVVTDLYTQAKAKLDSAGISHHTVNK

SEQ ID NO: 2346 - protein, 125 aa, Unknown; identical to SEQ ID NO: 2345
  Description of Unknown: uncultivated organism
  MG4-107 RuvC-III domain

SEQ ID NO: 2347 - protein, 125 aa, Unknown; identical to SEQ ID NO: 2343
  Description of Unknown: uncultivated organism
  MG4-108 RuvC-III domain

SEQ ID NO: 2348 - protein, 125 aa, Unknown; identical to SEQ ID NO: 2343
  Description of Unknown: uncultivated organism with predicted taxonomy: Planctomycetes bacterium
  MG4-109 RuvC-III domain

SEQ ID NO: 2349 - protein, 125 aa, Unknown; identical to SEQ ID NO: 2343
  Description of Unknown: uncultivated organism
  MG4-110 RuvC-III domain

SEQ ID NO: 2350 - protein, 125 aa, Unknown
  Description of Unknown: uncultivated organism with predicted taxonomy: Planctomycetes bacterium
  MG4-111 RuvC-III domain
NDTRYASKLATEYLALLYGGRNDRNGVQRIQCSAGGCTAVVRRAWGGNYLLGEGEKVRGDHRHHAIDALTIAVTSPAIVKLIAGVKGEDRRRAIEEKRPLVVTDLYTQAKAKLDSAGISHHTVNK

SEQ ID NO: 2351 - protein, 125 aa, Unknown; identical to SEQ ID NO: 2343
  Description of Unknown: uncultivated organism
  MG4-112 RuvC-III domain

SEQ ID NO: 2352 - protein, 125 aa, Unknown; identical to SEQ ID NO: 2345
  Description of Unknown: uncultivated organism
  MG4-113 RuvC-III domain

SEQ ID NO: 2353 - protein, 125 aa, Unknown; identical to SEQ ID NO: 2343
  Description of Unknown: uncultivated organism
  MG4-114 RuvC-III domain

SEQ ID NO: 2354 - protein, 125 aa, Unknown; identical to SEQ ID NO: 2343
  Description of Unknown: uncultivated organism
  MG4-115 RuvC-III domain

SEQ ID NO: 2355 - protein, 141 aa, Unknown
  Description of Unknown: uncultivated organism
  MG4-116 RuvC-III domain
NDTRYSSRLACDLIAKLYGGRVIETETGTRQVVFASSGMVTATLRKGLGLEAVLCEASGSSNGETRGKSRTDHRHHAIDALTIALTRQSMIQTMSRTASLEPNWAITSRSLRTIPSPWSNFIDSVRPHVQELLVSHRPEHR

SEQ ID NO: 2356 - protein, 140 aa, Unknown
  Description of Unknown: uncultivated organism with predicted taxonomy: Acidobacteriales bacterium 59-55
  MG4-117 RuvC-III domain
NDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHK

SEQ ID NO: 2357 - protein, 141 aa, Unknown; identical to SEQ ID NO: 2355
  Description of Unknown: uncultivated organism
  MG4-118 RuvC-III domain

SEQ ID NO: 2358 - protein, 140 aa, Unknown; identical to SEQ ID NO: 2356
  Description of Unknown: uncultivated organism
  MG4-119 RuvC-III domain

SEQ ID NO: 2359 - protein, 141 aa, Unknown; identical to SEQ ID NO: 2355
  Description of Unknown: uncultivated organism
  MG4-120 RuvC-III domain

SEQ ID NO: 2360 - protein, 140 aa, Unknown
  Description of Unknown: uncultivated organism with predicted taxonomy: Acidobacteriales bacterium 59-55
  MG4-121 RuvC-III domain
NDTRYASVLASRFLGALYGGRDLVDAEKVRQVIFASSGAVTATLRSSWGLEAILREIVPTEPGEPRGKPRTDHRHHAIDAITIALTRPKVIQSMALAASLEPWQRDSRAWRKIESPWRDFVLSIRPHIEQMLVSHRPEHK

SEQ ID NO: 2361 - protein, 140 aa, Unknown
  Description of Unknown: uncultivated organism with predicted taxonomy: uncultured bacterium
  MG4-122 RuvC-III domain
NDTRYASVLAARFLGSLYGGRDVVDGDNARQVIFASSGAVTASLRSSWGLEAILHEIVPAESGESRGKPRTDHRHHAIDAITIALTRPKVIQSMARTASLEPWQIDSRAWRKIELPWRDFVPSIRPHIEQMLVSHRPEHK

SEQ ID NO: 2362 - protein, 141 aa, Unknown; identical to SEQ ID NO: 2355
  Description of Unknown: uncultivated organism
  MG4-123 RuvC-III domain

SEQ ID NO: 2363 - protein, 141 aa, Unknown; identical to SEQ ID NO: 2355
  Description of Unknown: uncultivated organism
  MG4-124 RuvC-III domain

SEQ ID NO: 2364 - protein, 141 aa, Unknown; identical to SEQ ID NO: 2355
  Description of Unknown: uncultivated organism
  MG4-125 RuvC-III domain

SEQ ID NO: 2365 - protein, 141 aa, Unknown
  Description of Unknown: uncultivated organism
  MG4-126 RuvC-III domain
NDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHR

SEQ ID NO: 2366 - protein, 140 aa, Unknown; identical to SEQ ID NO: 2361
  Description of Unknown: uncultivated organism
  MG4-127 RuvC-III domain

SEQ ID NO: 2367 - protein, 140 aa, Unknown; identical to SEQ ID NO: 2356
  Description of Unknown: uncultivated organism with predicted taxonomy: Acidobacteriales bacterium 59-55
  MG4-128 RuvC-III domain

SEQ ID NO: 2368 - protein, 142 aa, Unknown
  Description of Unknown: uncultivated organism
  MG4-129 RuvC-III domain
NDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHK

SEQ ID NO: 2369 - protein, 132 aa, Unknown
  Description of Unknown: uncultivated organism with predicted taxonomy: Planctomycetes
  MG4-130 RuvC-III domain
QDTRYMSRLATEYLGLLYGGTIDADHTRRVQVSAGRVTAYLRDEWGLNAILADGGEEEKNRDDHRHHAVDASVIALTNAGTVELLSHSAEVAAERGRRLFVREEIQQPWPTFLDDVRRAIEAINISYRVNRR

SEQ ID NO: 2370 - protein, 140 aa, Unknown; identical to SEQ ID NO: 2356
  Description of Unknown: uncultivated organism
  MG4-131 RuvC-III domain

SEQ ID NO: 2371 - protein, 128 aa, Unknown
  Description of Unknown: uncultivated organism with predicted taxonomy: Planctomycetes bacterium
  MG4-132 RuvC-III domain
NDTRYTSLLAARLLSTLYGGRDVTENGKNRQVIFASTGAVTATLRRNWGFEQILRGIIPAEPGESSGKPRTDHRHHAIDAIVIALTRNNVIQAMARASALEAWQSGTRSWRHVPQPWRTPDFFRSVEQ

SEQ ID NO: 2372 - protein, 99 aa, Unknown
  Description of Unknown: uncultivated organism
  MG4-133 RuvC-III domain
NDTRYACKLACELVGTLYGGRDEKTDTDSRQVVFASSGMVTATLRKSWGLEAIMRETAPSANGQNHGKPRTDHRHHAIDAITIALSRPKMIATLSRNNA

SEQ ID NO: 2373 - protein, 140 aa, Unknown; identical to SEQ ID NO: 2356
  Description of Unknown: uncultivated organism with predicted taxonomy: Acidobacteriales bacterium 59-55
  MG4-134 RuvC-III domain

SEQ ID NO: 2374 - protein, 140 aa, Unknown; identical to SEQ ID NO: 2356
  Description of Unknown: uncultivated organism with predicted taxonomy: Acidobacteriales bacterium 59-55
  MG4-135 RuvC-III domain

SEQ ID NO: 2375 - protein, 140 aa, Unknown; identical to SEQ ID NO: 2356
  Description of Unknown: uncultivated organism with predicted taxonomy: Acidobacteriales bacterium 59-55
  MG4-136 RuvC-III domain

SEQ ID NO: 2376 - protein, 142 aa, Unknown
  Description of Unknown: uncultivated organism with predicted taxonomy: Acidobacteriales bacterium 59-55
  MG4-137 RuvC-III domain
NDTRYTSLLAARLLSTLYGGRDVTENGKNRQVIFASTGAVTATLRRNWGFEQILRGIIPAEPGESSGKPRTDHRHHAIDAIVIALTRNNVIQAMARASALEAWQSGTRSWRHVPQPWRTPDFFRSVEQQVAEVLTSHRPEHK

SEQ ID NO: 2377 - protein, 142 aa, Unknown
  Description of Unknown: uncultivated organism with predicted taxonomy: uncultured bacterium
  MG4-138 RuvC-III domain
NDTRYASKLACELVGTLYGGRDVPLKDGKSRQVVFASSGMVTSTLRKGWGLEAILREAAPSANGQNRGKPRTDHRHHAIDAITIALSRPKMIAALSRNNAQDPYWPNNGRTTPKIQSPWKDFVDSIRPHFEQMLVSHRPEHR

SEQ ID NO: 2378 - protein, 135 aa, Unknown
  Description of Unknown: uncultivated organism
  MG4-139 RuvC-III domain
NCIRYASQMACKLMGTLYGGRDMETAGRSRQIIFASTGMLTGTLRRAWGLEAILREETPSSIEGKPRNDYRHHAIDAIAVALSHPKLIAALSRSDDSYAWATRALLKIESPWKNFIDSIRPHFDQMLISHRPEHR

SEQ ID NO: 2379 - protein, 172 aa, Unknown
  Description of Unknown: uncultivated organism with predicted taxonomy: Planctomycetes bacterium
  MG4-140 RuvC-III domain
NDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRRIVVSRRPEHK

SEQ ID NO: 2380 - protein, 141 aa, Unknown; identical to SEQ ID NO: 2365
  Description of Unknown: uncultivated organism
  MG4-141 RuvC-III domain

SEQ ID NO: 2381 - protein, 62 aa, Unknown
  Description of Unknown: uncultivated organism with predicted taxonomy: Polaribacter sp. ALD11
  MG4-142 RuvC-III domain
NDTRYTSLLAARLLSTLYGGRDVAENGGKRQIIFASTGAVTATLRRNWGFEQILRNIIPPEP

SEQ ID NO: 2382 - protein, 140 aa, Unknown; identical to SEQ ID NO: 2356
  Description of Unknown: uncultivated organism
  MG4-143 RuvC-III domain

SEQ ID NO: 2383 - protein, 140 aa, Unknown; identical to SEQ ID NO: 2361
  Description of Unknown: uncultivated organism
  MG4-144 RuvC-III domain

SEQ ID NO: 2384 - protein, 66 aa, Unknown
  Description of Unknown: uncultivated organism
  MG4-145 RuvC-III domain
NDTRYACKLACELVGTLYGGRDEKTDTDSRQVVFASSGMVTATLRKSWGLEAIMRETAPSANGQNH

SEQ ID NO: 2385 - protein, 140 aa, Unknown; identical to SEQ ID NO: 2356
  Description of Unknown: uncultivated organism with predicted taxonomy: Acidobacteriales bacterium 59-55
  MG4-146 RuvC-III domain

SEQ ID NO: 2386 - protein, 141 aa, Unknown; identical to SEQ ID NO: 2365
  Description of Unknown: uncultivated organism
  MG4-147 RuvC-III domain

SEQ ID NO: 2387 - protein, 140 aa, Unknown; identical to SEQ ID NO: 2356
  Description of Unknown: uncultivated organism
  MG4-148 RuvC-III domain

SEQ ID NO: 2388 - protein, 140 aa, Unknown; identical to SEQ ID NO: 2356
  Description of Unknown: uncultivated organism
  MG4-149 RuvC-III domain

SEQ ID NO: 2389 - protein, 142 aa, Unknown
  Description of Unknown: uncultivated organism with predicted taxonomy: Polaribacter sp. ALD11
  MG4-150 RuvC-III domain
NDTRYTSLLAARLLSTLYGGRDLAENGRKRQIIFASSGAVTATLRRNWGFEQILRNIIPPEPNESSGKPRTDHRHHAIDAIVIALTRNDVIQAMARASALEPWQPGTRSWRHVPQPWHTPNFFRSVEEQVREMLTSHRPEHK

SEQ ID NO: 2390 - protein, 142 aa, Unknown; identical to SEQ ID NO: 2376
  Description of Unknown: uncultivated organism with predicted taxonomy: Acidobacteriales
  MG4-151 RuvC-III domain

SEQ ID NO: 2391 - protein, 141 aa, Unknown; identical to SEQ ID NO: 2365
  Description of Unknown: uncultivated organism
  MG4-152 RuvC-III domain

SEQ ID NO: 2392 - protein, 140 aa, Unknown; identical to SEQ ID NO: 2356
  Description of Unknown: uncultivated organism
  MG4-153 RuvC-III domain

SEQ ID NO: 2393 - protein, 140 aa, Unknown
  Description of Unknown: uncultivated organism with predicted taxonomy: Acidobacteriales bacterium 59-55
  MG4-154 RuvC-III domain
NDTRYASVLAARFLGSLYGGRDVVDGDNARQVIFASSGAVTATLRSSWGLEAILHEIVPAESGESRGKPRTDHRHHAIDAITIALTRSKVIQSMARTASLEPWQIDSRAWRKIELPWRDFVPSIRPHIEQMLVSHRPEHK

SEQ ID NO: 2394 - protein, 127 aa, Unknown
  Description of Unknown: uncultivated organism with predicted taxonomy: Deltaproteobacteria
  MG4-155 RuvC-III domain
NDTRYASKLAARYMACLYGGLSDSCGQRIFVSPGQVTAFLRRLWAIEGLLSGGGGKSRDDHRHHAIDAVVVALTGPAWVKALSDAASRAREEGRRRFASLEAPWPGFAAAVQDRLQGLTVSHRANLK

SEQ ID NO: 2395 - protein, 131 aa, Unknown
  Description of Unknown: uncultivated organism with predicted taxonomy: Planctomycetes bacterium
  MG4-156 RuvC-III domain
NDTKYASLLAMEFLGQLYGGVCDERGIRRVNAVSGGVTAQIRKGWRLHSILRDGPSQGEAKPRDDHRHHAIDALVIAMTDAGAVQAVSRASERSRLDHRHGFRVDDPWNGFLEQVQAVIRAIRVSHRPDHH

SEQ ID NO: 2396 - protein, 140 aa, Unknown; identical to SEQ ID NO: 2356
  Description of Unknown: uncultivated organism
  MG4-157 RuvC-III domain

SEQ ID NO: 2397 - protein, 140 aa, Unknown; identical to SEQ ID NO: 2356
  Description of Unknown: uncultivated organism
  MG4-158 RuvC-III domain

SEQ ID NO: 2398 - protein, 140 aa, Unknown; identical to SEQ ID NO: 2356
  Description of Unknown: uncultivated organism with predicted taxonomy: Acidobacteriales bacterium 59-55
  MG4-159 RuvC-III domain

SEQ ID NO: 2399 - protein, 132 aa, Unknown; identical to SEQ ID NO: 2369
  Description of Unknown: uncultivated organism with predicted taxonomy: Planctomycetes
  MG4-160 RuvC-III domain

SEQ ID NO: 2400 - protein, 140 aa, Unknown; identical to SEQ ID NO: 2356
  Description of Unknown: uncultivated organism with predicted taxonomy: Acidobacteriales bacterium 59-55
  MG4-161 RuvC-III domain

SEQ ID NO: 2401 - protein, 141 aa, Unknown; identical to SEQ ID NO: 2262
  Description of Unknown: uncultivated organism
  MG4-162 RuvC-III domain

SEQ ID NO: 2402 - protein, 142 aa, Unknown
  Description of Unknown: uncultivated organism with predicted taxonomy: Acidobacteriales bacterium 59-55
  MG4-163 RuvC-III domain
NDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWRTPDFFRSVEEQVREMLTSHRPEHK

SEQ ID NO: 2403 - protein, 141 aa, Unknown; identical to SEQ ID NO: 2365
  Description of Unknown: uncultivated organism
  MG4-164 RuvC-III domain

SEQ ID NO: 2404 - protein, 140 aa, Unknown; identical to SEQ ID NO: 2356
  Description of Unknown: uncultivated organism
  MG4-165 RuvC-III domain

SEQ ID NO: 2405 - protein, 140 aa, Unknown; identical to SEQ ID NO: 2393
  Description of Unknown: uncultivated organism with predicted taxonomy: Candidatus Sulfotelmatomonas gaucii
  MG4-166 RuvC-III domain

SEQ ID NO: 2406 - protein, 142 aa, Unknown; identical to SEQ ID NO: 2376
  Description of Unknown: uncultivated organism with predicted taxonomy: Acidobacteriales bacterium 59-55
  MG4-167 RuvC-III domain

SEQ ID NO: 2407 - protein, 141 aa, Unknown; identical to SEQ ID NO: 2365
  Description of Unknown: uncultivated organism
  MG4-168 RuvC-III domain

SEQ ID NO: 2408 - protein, 140 aa, Unknown; identical to SEQ ID NO: 2356
  Description of Unknown: uncultivated organism
  MG4-169 RuvC-III domain

SEQ ID NO: 2409 - protein, 141 aa, Unknown; identical to SEQ ID NO: 2365
  Description of Unknown: uncultivated organism
  MG4-170 RuvC-III domain

SEQ ID NO: 2410 - protein, 140 aa, Unknown; identical to SEQ ID NO: 2356
  Description of Unknown: uncultivated organism
  MG4-171 RuvC-III domain

SEQ ID NO: 2411 - protein, 140 aa, Unknown; identical to SEQ ID NO: 2356
  Description of Unknown: uncultivated organism
  MG4-172 RuvC-III domain

SEQ ID NO: 2412 - protein, 128 aa, Unknown
  Description of Unknown: uncultivated organism with predicted taxonomy: Ignavibacteriales bacterium CG_4_9_14_3_um_filter_30_11
  MG4-173 RuvC-III domain
QDTRYASKLACRYLGVLYGGTSDASGNQRVFASAGQVTAKLRRAWDLDRILSPDKPEKSRDDHRHHAIDALTVALSSTTLIRALATAAGEADRLFRRKIILPVPWVGFGEQARSAVENIQPSHRPMRK

SEQ ID NO: 2413 - protein, 78 aa, Unknown
  Description of Unknown: uncultivated organism with predicted taxonomy: uncultured bacterium
  MG4-174 RuvC-III domain
NDTRYASKLACELVGTLYGGRDVPLKDGKSRQVVFASSGMVTSTLRKGWGLEAILREAAPSANGQNRGKPRTDHRHHA

SEQ ID NO: 2414 - protein, 141 aa, Unknown; identical to SEQ ID NO: 2365
  Description of Unknown: uncultivated organism
  MG4-175 RuvC-III domain

SEQ ID NO: 2415 - protein, 140 aa, Unknown; identical to SEQ ID NO: 2356
  Description of Unknown: uncultivated organism with predicted taxonomy: Acidobacteriales bacterium 59-55
  MG4-176 RuvC-III domain

SEQ ID NO: 2416 - protein, 172 aa, Unknown
  Description of Unknown: uncultivated organism
  MG4-177 RuvC-III domain
NDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHK

SEQ ID NO: 2417 - protein, 140 aa, Unknown; identical to SEQ ID NO: 2356
  Description of Unknown: uncultivated organism with predicted taxonomy: Acidobacteriales bacterium 59-55
  MG4-178 RuvC-III domain

SEQ ID NO: 2418 - protein, 142 aa, Unknown; identical to SEQ ID NO: 2368
  Description of Unknown: uncultivated organism with predicted taxonomy: Acidobacteria
  MG4-179 RuvC-III domain

SEQ ID NO: 2419 - protein, 140 aa, Unknown; identical to SEQ ID NO: 2361
  Description of Unknown: uncultivated organism
  MG4-180 RuvC-III domain

SEQ ID NO: 2420 - protein, 141 aa, Unknown; identical to SEQ ID NO: 2365
  Description of Unknown: uncultivated organism
  MG4-181 RuvC-III domain

SEQ ID NO: 2421 - protein, 140 aa, Unknown; identical to SEQ ID NO: 2356
  Description of Unknown: uncultivated organism
  MG4-182 RuvC-III domain

SEQ ID NO: 2422 - protein, 80 aa, Unknown
  Description of Unknown: uncultivated organism
  MG4-183 RuvC-III domain
NDTRYASKLACELVGTLYGGRDVPLKDGKSRQVVFASSGMVTSTLRKGWGLEAILREAAPSANGQNRGKPRTDHRHHAID

SEQ ID NO: 2423 - protein, 140 aa, Unknown; identical to SEQ ID NO: 2361
  Description of Unknown: uncultivated organism
  MG4-184 RuvC-III domain

SEQ ID NO: 2424 - protein, 140 aa, Unknown; identical to SEQ ID NO: 2356
  Description of Unknown: uncultivated organism
  MG4-185 RuvC-III domain

SEQ ID NO: 2425 - protein, 141 aa, Unknown; identical to SEQ ID NO: 2365
  Description of Unknown: uncultivated organism
  MG4-186 RuvC-III domain

SEQ ID NO: 2426 - protein, 92 aa, Unknown
  Description of Unknown: uncultivated organism with predicted taxonomy: Polaribacter sp. ALD11
  MG4-187 RuvC-III domain
NDTRYTSLLAARLLSTLYGGRDVAENGGKRQIIFASTGAVTATLRRNWGFEQILRNIIPPEPSESTGKPRTDHRHHAIDAIVIALTRNDVIQ

SEQ ID NO: 2427 - protein, 140 aa, Unknown; identical to SEQ ID NO: 2356
  Description of Unknown: uncultivated organism with predicted taxonomy: Acidobacteriales bacterium 59-55
  MG4-188 RuvC-III domain

SEQ ID NO: 2428 - protein, 142 aa, Unknown; identical to SEQ ID NO: 2368
  Description of Unknown: uncultivated organism with predicted taxonomy: Polaribacter sp. ALD11
  MG4-189 RuvC-III domain

SEQ ID NO: 2429 - protein, 140 aa, Unknown; identical to SEQ ID NO: 2361
  Description of Unknown: uncultivated organism
  MG4-190 RuvC-III domain

SEQ ID NO: 2430 - protein, 141 aa, Unknown; identical to SEQ ID NO: 2365
  Description of Unknown: uncultivated organism
  MG4-191 RuvC-III domain

SEQ ID NO: 2431 - protein, 140 aa, Unknown; identical to SEQ ID NO: 2356
  Description of Unknown: uncultivated organism
  MG4-192 RuvC-III domain

SEQ ID NO: 2432 - protein, 140 aa, Unknown; identical to SEQ ID NO: 2356
  Description of Unknown: uncultivated organism with predicted taxonomy: Acidobacteriales bacterium 59-55
  MG4-193 RuvC-III domain

SEQ ID NO: 2433 - protein, 141 aa, Unknown; identical to SEQ ID NO: 2365
  Description of Unknown: uncultivated organism
  MG4-194 RuvC-III domain

SEQ ID NO: 2434 - protein, 140 aa, Unknown; identical to SEQ ID NO: 2356
  Description of Unknown: uncultivated organism
  MG4-195 RuvC-III domain

SEQ ID NO: 2435 - protein, 142 aa, Unknown; identical to SEQ ID NO: 2368
  Description of Unknown: uncultivated organism with predicted taxonomy: Acidobacteriales bacterium 59-55
  MG4-196 RuvC-III domain

SEQ ID NO: 2436 - protein, 140 aa, Unknown; identical to SEQ ID NO: 2356
  Description of Unknown: uncultivated organism
  MG4-197 RuvC-III domain

SEQ ID NO: 2437 - protein, 131 aa, Unknown; identical to SEQ ID NO: 2395
  Description of Unknown: uncultivated organism
  MG4-198 RuvC-III domain

SEQ ID NO: 2438 - protein, 141 aa, Unknown; identical to SEQ ID NO: 2365
  Description of Unknown: uncultivated organism
  MG4-199 RuvC-III domain

SEQ ID NO: 2439 - protein, 141 aa, Unknown; identical to SEQ ID NO: 2365
  Description of Unknown: uncultivated organism
  MG4-200 RuvC-III domain

SEQ ID NO: 2440 - protein, 142 aa, Unknown; identical to SEQ ID NO: 2368
  Description of Unknown: uncultivated organism with predicted taxonomy: Acidobacteriales bacterium 59-55
  MG4-201 RuvC-III domain

SEQ ID NO: 2441 - protein, 140 aa, Unknown; identical to SEQ ID NO: 2356
  Description of Unknown: uncultivated organism with predicted taxonomy: Acidobacteriales bacterium 59-55
  MG4-202 RuvC-III domain

SEQ ID NO: 2442 - protein, 140 aa, Unknown; identical to SEQ ID NO: 2356
  Description of Unknown: uncultivated organism with predicted taxonomy: Acidobacteriales bacterium 59-55
  MG4-203 RuvC-III domain

SEQ ID NO: 2443 - protein, 140 aa, Unknown; identical to SEQ ID NO: 2356
  Description of Unknown: uncultivated organism with predicted taxonomy: Acidobacteriales bacterium 59-55
  MG4-204 RuvC-III domain

SEQ ID NO: 2444 - protein, 128 aa, Unknown
  Description of Unknown: uncultivated organism with predicted taxonomy: Acidobacteria
  MG4-205 RuvC-III domain
QDTRYASKLACRYLGVLYGGTIDASGKRRVFASAGQVTAKLRRAWDLDRILSPDKPEKCRDDHRHHAIDALTVALSSTTLIRELARAAGEADRLFRRKIILPVPWVGFGEQTRSAVERIQPSHRPMRK

SEQ ID NO: 2445 - protein, 140 aa, Unknown; identical to SEQ ID NO: 2356
  Description of Unknown: uncultivated organism
  MG4-206 RuvC-III domain

SEQ ID NO: 2446 - protein, 128 aa, Unknown; identical to SEQ ID NO: 2444
  Description of Unknown: uncultivated organism
  MG4-207 RuvC-III domain

SEQ ID NO: 2447 - protein, 140 aa, Unknown; identical to SEQ ID NO: 2361
  Description of Unknown: uncultivated organism
  MG4-208 RuvC-III domain

SEQ ID NO: 2448 - protein, 141 aa, Unknown; identical to SEQ ID NO: 2365
  Description of Unknown: uncultivated organism
  MG4-209 RuvC-III domain

SEQ ID NO: 2449 - protein, 167 aa, Unknown
  Description of Unknown: uncultivated organism with predicted taxonomy: candidate division Kazan bacterium
  MG4-210 RuvC-III domain
NDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSH

SEQ ID NO: 2450 - protein, 142 aa, Unknown; identical to SEQ ID NO: 2368
  Description of Unknown: uncultivated organism with predicted taxonomy: Acidobacteriales bacterium 59-55
  MG4-211 RuvC-III domain

SEQ ID NO: 2451 - protein, 140 aa, Unknown; identical to SEQ ID NO: 2361
  Description of Unknown: uncultivated organism
  MG4-212 RuvC-III domain

SEQ ID NO: 2452 - protein, 142 aa, Unknown; identical to SEQ ID NO: 2368
  Description of Unknown: uncultivated organism with predicted taxonomy: Polaribacter sp. ALD11
  MG4-213 RuvC-III domain

SEQ ID NO: 2453 - protein, 141 aa, Unknown; identical to SEQ ID NO: 2365
  Description of Unknown: uncultivated organism
  MG4-214 RuvC-III domain

SEQ ID NO: 2454 - protein, 172 aa, Unknown; identical to SEQ ID NO: 2416
  Description of Unknown: uncultivated organism
  MG4-215 RuvC-III domain

SEQ ID NO: 2455 - protein, 140 aa, Unknown; identical to SEQ ID NO: 2356
  Description of Unknown: uncultivated organism
  MG4-216 RuvC-III domain

SEQ ID NO: 2456 - protein, 80 aa, Unknown
  Description of Unknown: uncultivated organism with predicted taxonomy: candidate division Zixibacteria bacterium CG_4_9_14_3_um_filter_46_8
  MG4-217 RuvC-III domain
SDTRYASKLAMRYLALLYGGLSDEGGTQRIQAGSGNVTKHVRQAHRLNGILGDGPGKNRNDHRHHAVDALAIALTDQALV

SEQ ID NO: 2457 - protein, 128 aa, Unknown
  Description of Unknown: uncultivated organism with predicted taxonomy: Planctomicrobium piriforme
  MG4-218 RuvC-III domain
NDTRYATRQATDYLALLYGGLYEKGGKRFIQAAKGGTTAYLRNEWQLNSILGDGGTKSRDDHRHHAVDAVAIALTDAGTVKMLSDAAGRAAQEGRRRFGRVEDPWPGFLDDVRQAIEGLNVSHRVSRK

SEQ ID NO: 2458 - protein, 140 aa, Unknown; identical to SEQ ID NO: 2393
  Description of Unknown: uncultivated organism with predicted taxonomy: Candidatus Sulfotelmatomonas gaucii
  MG4-219 RuvC-III domain

SEQ ID NO: 2459 - protein, 135 aa, Unknown
  Description of Unknown: uncultivated organism with predicted taxonomy: Proteobacteria
  MG4-220 RuvC-III domain
NDTRYASTMAGDYLGFLYGGKIDSQRNLRVRATTGQVTAYLRDEWMLNRILRDGPTEQGGKVAKSREDHRHHAVDAIAIALTDESTIQQLSRAAQQAPQLGRRRFAPVQAPWPDFVDSVRAEIGRIVVSHRPNRK

SEQ ID NO: 2460 - protein, 142 aa, Unknown; identical to SEQ ID NO: 2368
  Description of Unknown: uncultivated organism with predicted taxonomy: Acidobacteriales bacterium 59-55
  MG4-221 RuvC-III domain

SEQ ID NO: 2461 - protein, 140 aa, Unknown; identical to SEQ ID NO: 2356
  Description of Unknown: uncultivated organism
  MG4-222 RuvC-III domain

SEQ ID NO: 2462 - protein, 141 aa, Unknown; identical to SEQ ID NO: 2365
  Description of Unknown: uncultivated organism
  MG4-223 RuvC-III domain

SEQ ID NO: 2463 - protein, 140 aa, Unknown; identical to SEQ ID NO: 2361
  Description of Unknown: uncultivated organism
  MG4-224 RuvC-III domain

SEQ ID NO: 2464 - protein, 172 aa, Unknown
  Description of Unknown: uncultivated organism
  MG4-225 RuvC-III domain
NDTLYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHK

SEQ ID NO: 2465 - protein, 92 aa, Unknown; identical to SEQ ID NO: 2426
  Description of Unknown: uncultivated organism with predicted taxonomy: Polaribacter sp. ALD11
  MG4-226 RuvC-III domain

SEQ ID NO: 2466 - protein, 141 aa, Unknown; identical to SEQ ID NO: 2365
  Description of Unknown: uncultivated organism
  MG4-227 RuvC-III domain

SEQ ID NO: 2467 - protein, 130 aa, Unknown
  Description of Unknown: uncultivated organism
  MG4-247 RuvC-III domain
PDTAYASRLAVEYLGRLYGGRGGVDADGNRRVQAGRGQVTAYLRNEWGLNKILNDGGEKSRDDHRHHAVDAICVALTDAGTVKMLSDAASRATIERRRRFGKVNPPWPTFLDDVRKSIEGLIVSHRVSRK

SEQ ID NO: 2468 - protein, 130 aa, Unknown; identical to SEQ ID NO: 2467
  Description of Unknown: uncultivated organism with predicted taxonomy: Planctomycetes
  MG4-248 RuvC-III domain

SEQ ID NO: 2469 - protein, 135 aa, Unknown
  Description of Unknown: uncultivated organism with predicted taxonomy: Fuerstia marisgermanicae
  MG4-249 RuvC-III domain
QDTAYASKLAKRYLGLLYGGEIDNLGKRRVTATSGMVTWDLRGGWDLNGILNDGRTSNGSTVVKTRDDHRHHAVDAVVIALTDDRSIQQLNKAAAMGQMQGKRGIIKLPSTWNNFVDTVRAEIGRIIVSHRVSKK

SEQ ID NO: 2470 - protein, 134 aa, Unknown
  Description of Unknown: uncultivated organism
  MG4-250 RuvC-III domain
NDTAYASKLACQYLGVLYGGVEDSTGKKRVKASSGGVTGYLRRLWNLNRILNDGPTKSGGFIPKTRDDHRHHAVDAVVIGLTDESVVHKLSRAAERGFYRGRPFAPLEGLWPNFVPSIKTEIDRVVVSHRVSKK

SEQ ID NO: 2471 - protein, 126 aa, Unknown
  Description of Unknown: uncultivated organism
  MG4-251 RuvC-III domain
NDTRYASRLAVKYLGMLYGGVIDAAGKQRVFATTGGATAIVRRAWGANFLLGEGEKVRDDHRHHAIDALTIALTTPDIVKIIAGMPEELRRAKGKTPDDTIIDNAVFKQAKEMLDKAAVSHHIVNK

SEQ ID NO: 2472 - protein, 125 aa, Unknown
  Description of Unknown: uncultivated organism with predicted taxonomy: Bdellovibrio exovorus
  MG4-252 RuvC-III domain
NDTRYASRLAMNYLGLLYGGAIDRNGKRRIQACSGGCTALIRRAWGANYLLGDGEKKREDHRHHAIDALTIAIITPEIVKTVANISKDEYKRRHMQNLPMLDDALYLQAEGKIDSATVSHHVVNK

SEQ ID NO: 2473 - protein, 126 aa, Unknown; identical to SEQ ID NO: 2471
  Description of Unknown: uncultivated organism
  MG4-253 RuvC-III domain

SEQ ID NO: 2474 - protein, 126 aa, Unknown
  Description of Unknown: uncultivated organism
  MG4-254 RuvC-III domain
NDTRYASRLAMQYLALLYGGIIDKTGKQRIFATSGSCTAMIRRAWGGNYLLGEGEKVRDDHRHHAIDALTIALTTPEMIKVIASMTREERSRKQKSCNDTIIDNEIFRQASADLDNIPVSHHVVNK

SEQ ID NO: 2475 - protein, 126 aa, Unknown; identical to SEQ ID NO: 2471
  Description of Unknown: uncultivated organism
  MG4-255 RuvC-III domain

SEQ ID NO: 2476 - protein, 126 aa, Unknown; identical to SEQ ID NO: 2471
  Description of Unknown: uncultivated organism
  MG4-256 RuvC-III domain

SEQ ID NO: 2477 - protein, 144 aa, Unknown
  Description of Unknown: uncultivated organism with predicted taxonomy: Planctomycetes
  MG4-257 RuvC-III domain
NDTKFASREAGDYLGLLYGGRVDADGNTRVQMTKGGITSELRNALQLGSIPSQVEDWICDPEEKRGKDRGDHRHHAIDAIAIALSSPGIIKPLMGAYSSSETAKKEMRRDIWASFAKKAAWPGFSDNVVEAVNSISISRRPKHR

SEQ ID NO: 2478 - protein, 145 aa, Unknown
  Description of Unknown: uncultivated organism
  MG4-258 RuvC-III domain
NDTRYVSKLAARYVGMLYGGRDVPQPDGAAKRVVFASTGMLTASLRRTWGLEAILREPEPAETSRKPGKQRTDNRHHAIDAIVIALTSNAVIQKASSVAATGSYGDAARAISRVQPPWGDFVGDFVDSIRPAIERMVVSHRPSHK

SEQ ID NO: 2479 - protein, 142 aa, Unknown
  Description of Unknown: uncultivated organism with predicted taxonomy: Acidobacteria
  MG4-259 RuvC-III domain
NDTRYTTRLAADLLGSLYGGRDETLPDGAKRRAIFATTGQVTATLRRVWNLESILREALPSANGESKGKPRTDHRHHAIDAIVVALTSQRTVQLLSMAAAQSVAGESRSRVFTGIQSPWPNFVDSIRPHIEQMIVSHRPEHK

SEQ ID NO: 2480 - protein, 141 aa, Unknown
  Description of Unknown: uncultivated organism with predicted taxonomy: Planctomycetes bacterium
  MG4-260 RuvC-III domain
NDTRYASKLACELVGSLFGGRDAQTENGSRQIVFASSGMVTATLRKGWGLEAILREAAPSANGQNRGKPRTDHRHHAIDAITIALSRPKMIATLSRNNAQDPYWPQNGRTAPRIQSPWKDFVGSIRPHFEQMLVSHRPEHR

SEQ ID NO: 2481 - protein, 125 aa, Unknown
  Description of Unknown: uncultivated organism
  MG4-261 RuvC-III domain
NDTRYASKLSMRYLAFLYGGIVDKNSIRRIFSVAGGCTALIRRAWGGNYLLGEGEKVRDDHRHHAIDAVTVALTTPELVQKIAKLSQEGRRKLNDSTKNFIDNDFYYQAQGMMDSCAVSHHQTNK

SEQ ID NO: 2482 - protein, 115 aa, Unknown
  Description of Unknown: uncultivated organism with predicted taxonomy: Planctomycetes
  MG6-7 RuvC-III domain
NDTRYITREILRYLKQLGCTVTGSRGKVTSELRHQWGLNSILESDLPGPKNREDHRHHAIDAVVTALTNQKHLHELAATKYAVAHDGFPVPWEGFRDAVAQAVNKIQVSHRVTRK

SEQ ID NO: 2483 - protein, 115 aa, Unknown
  Description of Unknown: uncultivated organism with predicted taxonomy: Planctomycetes bacterium
  MG6-8 RuvC-III domain
NDTRYISREVVKYLKQLGCIVTGTKGQITSELRHQWGLNNILDYTGAGLKNRDDHRHHAVDAVVTAVTEQKHLGGLAASKYDKSGIEFDPPWEGFREQVAEKINAINVSHRVTRK

SEQ ID NO: 2484 - protein, 115 aa, Unknown
  Description of Unknown: uncultivated organism
  MG6-9 RuvC-III domain
NDTRYICKEVVKYLKQLGVNVRGSKGRVTAELRHQWGLNSILDLNNSNMKNRDDHRHHAIDAVVTAVTKNEHLRRLAKSKYSKTDSSFSEPWEDFREELAEKVKHINVSHRVRRK

SEQ ID NO: 2485 - protein, 117 aa, Unknown
  Description of Unknown: uncultivated organism with predicted taxonomy: Planctomycetes bacterium
  MG6-10 RuvC-III domain
NDTRYICREAVRYLKQICSNVKGTRGKITSELRHQWGLNSILNLTDPNMKNRDDHRHHAIDAAVVAVTRNKHLRELAESKYAKTGSGVKFEAPWKDFREELAEKIKHINVSHRVTRK

SEQ ID NO: 2486 - protein, 115 aa, Unknown; identical to SEQ ID NO: 2483
  Description of Unknown: uncultivated organism with predicted taxonomy: Planctomycetes bacterium
  MG6-11 RuvC-III domain

SEQ ID NO: 2487 - protein, 115 aa, Unknown; identical to SEQ ID NO: 2484
  Description of Unknown: uncultivated organism
  MG6-12 RuvC-III domain

SEQ ID NO: 2488 - protein, 117 aa, Unknown; identical to SEQ ID NO: 2485
  Description of Unknown: uncultivated organism with predicted taxonomy: Planctomycetes bacterium
  MG6-13 RuvC-III domain

SEQ ID NO: 2489 - protein, 126 aa, Unknown
  Description of Unknown: uncultivated organism
  MG6-20 RuvC-III domain
NDTAYIAREVRQYLKCLYSEEELVRDESVVCTRGQVTSDLCWCWELNSILNPDDQRETKNRADLRHHAIDAIVVALTTRQRLFALSQVFAKKHSLAKAKHEPWPHFREDVENAVLAIKVSHRPRKR

SEQ ID NO: 2490 - protein, 159 aa, Unknown
  Description of Unknown: uncultivated organism with predicted taxonomy: Arcicella aurantiaca
  MG7-2 RuvC-III domain
NETQYITKQVKAELDKICRTITVTSGGITDYLRHQWGVDDVLKNINLEKYEAAGKVSDEDYRDRQGHWRTRKKIADWSKRDDHRHHAIDALVIACTKPAYIKRLNDLNQEYDSYKEMKKDGGKMESLTKFPQPKMKGGFIQNVTKATENILISFKAGKK

SEQ ID NO: 2491 - protein, 95 aa, Unknown
  Description of Unknown: uncultivated organism with predicted taxonomy: Flavobacteriales
  MG7-5 RuvC-III domain
KETQYITKQVKAELDKICRKITVTSGGITDYLRHQWGVDDVLKNINLEKYEAAGKVHDEEYRDRQGHWRTRKKIADWSKREDHRHHAIDALGIAC

SEQ ID NO: 2492 - protein, 88 aa, Unknown
  Description of Unknown: uncultivated organism with predicted taxonomy: Arcicella aurantiaca
  MG7-6 RuvC-III domain
NETQYITKQVKAELDKICKKITVTSGGITDYLRHQWGVDDVLKNINLEKYEAAEKVHDEEYRDRQGHWRTRKKIADWSKRDDHRHHAI

SEQ ID NO: 2493 - protein, 156 aa, Unknown
  Description of Unknown: uncultivated organism
  MG7-9 RuvC-III domain
RESQYIARKAVEVLREVCRNVYTTTGSITDFLRHRWGWDEVIPYLRLPQFKEAGLTEIIPVQNGQKTKEVIKGWSKRDDHRHHALDALVVACTRQSHIQRINELSPILAGTYGEERRQQLLDIVRDKYIAGKIPFSFRQVCEAMNQVLVSHKQRTR

SEQ ID NO: 2494 - protein, 158 aa, Unknown
  Description of Unknown: uncultivated organism with predicted taxonomy: Bacteroidetes
  MG7-10 RuvC-III domain
RETQYIAKKAVEMLRQVCREVRSTTGSITDFLRHQWGWDEVIKELRLPQFRQAGEDLIEYRPAANGGRDRVVIKDWDKRKDHRHHALDALVVAFTRVSHIQRVTKLNQIMSGKFGEERRKELLRTGRDLYIAGKAPFTFAQVSKAIANILISFKQGLR

SEQ ID NO: 2495 - protein, 150 aa, Unknown
  Description of Unknown: uncultivated organism with predicted taxonomy: Bacteroidetes
  MG7-11 RuvC-III domain
RETAYISREVKNLLLGICRNVHSTSGTVTNYLRHIWGLDSILQELNIEKYRACGQTVKEIIGSNGSTKENERIVNWSKRDDHRHHAIDAIVIALTKQSHIQKLNNLNQEFQNYRELKQSAYNFPLPWATVHSDVLRTVSNILVSFKSGKK

SEQ ID NO: 2496 - protein, 158 aa, Unknown; identical to SEQ ID NO: 2494
  Description of Unknown: uncultivated organism with predicted taxonomy: Bacteroidetes
  MG7-12 RuvC-III domain

SEQ ID NO: 2497 - protein, 148 aa, Unknown
  Description of Unknown: uncultivated organism with predicted taxonomy: Deltaproteobacteria bacterium
  MG7-13 RuvC-III domain
KETQYITKVVREKLWEVSHEVRTTTGAITGFLRHEWGLSNLLHDLNFPKYEAQGLVEEWVDEETGEVIKRIEDWSKRMDHRHHALDALVVALTRPAHVHYLNNLNKQFGNLARENGWRTPLRSPVTNLYQKARAAMEPILVKHQKKSR

SEQ ID NO: 2498 - protein, 148 aa, Unknown
  Description of Unknown: uncultivated organism with predicted taxonomy: Deltaproteobacteria bacterium
  MG7-14 RuvC-III domain
KETQYITKVVREKLREVSHEVRTTTGAITGFLRHEWGLSNLLHDLNFPKYEAQGLVEEWVDEETGEVIKRIEDWSKRMDHRHHALDALVVALTRPAHVHYLNNLNKQFGNLARENGWRTPLRSPVTNLYQKARAAMEPILVKHQKKSR

SEQ ID NO: 2499 - protein, 137 aa, Unknown
  Description of Unknown: uncultivated organism with predicted taxonomy: Collinsella
  MG14-1 RuvC-III domain
TDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRK

SEQ ID NO: 2500 - protein, 126 aa, Unknown
  Description of Unknown: uncultivated organism
  MG14-3 RuvC-III domain
NDTRYMSRAVAKWLDGCLPFPDDGHRHVFAVSGGATAMLRRAWDIAILDEEGKKDRDDDRHHAIDAALIAACTPSIVMKVAKANEMWQSDAERESLFLGSMPFPDFKQKVEAWIPCIVPTLYLPRN

SEQ ID NO: 2501 - protein, 137 aa, Unknown
  Description of Unknown: uncultivated organism with predicted taxonomy: Coriobacteriales
  MG14-4 RuvC-III domain
TDTAYMSREVCSYLSDCLLFPEDGSKVHVVPTTGRATAWLRRRWGLNFGSTGEKDRTDDRHHATDACVIAACSRSLVIKTAKISQETHWSVTPGLTESQRKDARMKALESVMPWETFANEVRSRHDFVVPTRFVPRK

SEQ ID NO: 2502 - protein, 137 aa, Unknown; identical to SEQ ID NO: 2501
  Description of Unknown: uncultivated organism with predicted taxonomy: Actinobacteria
  MG14-5 RuvC-III domain

SEQ ID NO: 2503 - protein, 126 aa, Unknown; identical to SEQ ID NO: 2500
  Description of Unknown: uncultivated organism with predicted taxonomy: Collinsella
  MG14-6 RuvC-III domain

SEQ ID NO: 2504 - protein, 137 aa, Unknown
  Description of Unknown: uncultivated organism with predicted taxonomy: Collinsella
  MG14-7 RuvC-III domain
TDTAYMSREVCAYLADCLLFPDDGAKAHVVPTTGRTTAWLRRRWGLNFGLTGKKDRSDDRHHATDACVIAACSPSLVIKSAQINQKMHWSMTKGMSKAQRQDAIMKALENVMPWETFANEVRTVHKLIIPTRFVPRK

SEQ ID NO: 2505 - protein, 128 aa, Unknown
  Description of Unknown: uncultivated organism with predicted taxonomy: Olsenella
  MG14-8 RuvC-III domain
NDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHG

SEQ ID NO: 2506 - protein, 128 aa, Unknown
  Description of Unknown: uncultivated organism with predicted taxonomy: Olsenella sp. KH3B4
  MG14-9 RuvC-III domain
NDDRYMSVAVKNYLEDCLLFPEDGRKRHVIAVAGGATGNLRWVWGLNFGDGNVKDRTDDRHHAVDAAIIAACSESTVKKIAEASSKGREAFKKQRESRLADTQPWPTFADEVKARRAFVVPTRMADHG

SEQ ID NO: 2507 - protein, 137 aa, Unknown
  Description of Unknown: uncultivated organism with predicted taxonomy: Collinsella
  MG14-10 RuvC-III domain
TDTAYMSREVCAYLADCLLFPEDGTKSHVVPTTGRATAWLRRRWGLNFGTNGEKDRSDDRHHATDACVIAACSRSLVIKTAHISEQTHWTVTKNLDKDERNRLRMKALENVMPWETFANEVRASHDFVIPTRFVPRK

SEQ ID NO: 2508 - protein, 103 aa, Unknown
  Description of Unknown: uncultivated organism with predicted taxonomy: Collinsella sp. AF20-14LB
  MG14-11 RuvC-III domain
NDTRYMSKDVAKWLADCLPFPKDGRRHVFCVSGAATGLMRRVWRIGILDENGKKDREDDRHHAVDAAVIAACTPSVVKSIALISEEHATHRDADRLLNRSLPY

SEQ ID NO: 2509 - protein, 137 aa, Unknown
  Description of Unknown: uncultivated organism with predicted taxonomy: Collinsella
  MG14-12 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRK

SEQ ID NO: 2510 - protein, 137 aa, Unknown; identical to SEQ ID NO: 2509
  Description of Unknown: uncultivated organism with predicted taxonomy: Collinsella
  MG14-13 RuvC-III domain

SEQ ID NO: 2511 - protein, 128 aa, Unknown
  Description of Unknown: uncultivated organism with predicted taxonomy: Olsenella
  MG14-14 RuvC-III domain
NDDRYMSVAVKNYLEDCLLFPEDGRKRHVTAVAGGATGNLRWVWGLNFGEGNVKDRADDRHHAIDAAIIAACSESTVKKVAEASAKGREAFKQLRKSRLADTQPWPTFATEVAARREFVVPTRMADHG

SEQ ID NO: 2512 - protein, 137 aa, Unknown; identical to SEQ ID NO: 2509
  Description of Unknown: uncultivated organism with predicted taxonomy: Coriobacteriales
  MG14-15 RuvC-III domain

SEQ ID NO: 2513 - protein, 126 aa, Unknown
  Description of Unknown: uncultivated organism with predicted taxonomy: Eggerthellales
  MG14-16 RuvC-III domain
NDTRYMSAALAKWLRECLPFARDGHEHVFCVAGGATALMRSVWDIGITGPDGKKNRDDDRHHAVDAAVIACCTPGIVKNVALVNEGHARADVRQRLFSDSLPYPEFKEQVNAWIPCIVPTLTLPNT

SEQ ID NO: 2514 - protein, 137 aa, Unknown; identical to SEQ ID NO: 2509
  Description of Unknown: uncultivated organism with predicted taxonomy: Collinsella
  MG14-17 RuvC-III domain

SEQ ID NO: 2515 - protein, 128 aa, Unknown; identical to SEQ ID NO: 2505
  Description of Unknown: uncultivated organism with predicted taxonomy: Olsenella
  MG14-18 RuvC-III domain

SEQ ID NO: 2516 - protein, 137 aa, Unknown; identical to SEQ ID NO: 2509
  Description of Unknown: uncultivated organism with predicted taxonomy: Coriobacteriales
  MG14-19 RuvC-III domain

SEQ ID NO: 2517 - protein, 137 aa, Unknown; identical to SEQ ID NO: 2509
  Description of Unknown: uncultivated organism with predicted taxonomy: Coriobacteriales
  MG14-20 RuvC-III domain

SEQ ID NO: 2518 - protein, 128 aa, Unknown; identical to SEQ ID NO: 2505
  Description of Unknown: uncultivated organism with predicted taxonomy: Olsenella sp. KH3B4
  MG14-21 RuvC-III domain

SEQ ID NO: 2519 - protein, 137 aa, Unknown; identical to SEQ ID NO: 2509
  Description of Unknown: uncultivated organism with predicted taxonomy: Collinsella
  MG14-22 RuvC-III domain

SEQ ID NO: 2520 - protein, 137 aa, Unknown; identical to SEQ ID NO: 2509
  Description of Unknown: uncultivated organism with predicted taxonomy: Collinsella
  MG14-23 RuvC-III domain

SEQ ID NO: 2521 - protein, 137 aa, Unknown
  Description of Unknown: uncultivated organism with predicted taxonomy: Collinsella
  MG14-24 RuvC-III domain
TDTAYMSREVCAYLADCLLFPEDGTKSHVVPTTGRATAWLRRRWGLNFGTNGEKDRSDDRHHATDACVIAACSRSLVIKTAKISEQTHWTVTKNLDKDERDHLRMKALENVMPWETFANEVRASHDFVIPTRFVPRK

SEQ ID NO: 2522 - protein, 128 aa, Unknown
  Description of Unknown: uncultivated organism with predicted taxonomy: Olsenella
  MG14-25 RuvC-III domain
NDDRYMSVAVKNYLEDCLLFPEDGRKRHVTAVAGGATGNLRWVWGLNFGEGNVKDRADDRHHAIDAAIIAACSESTVKKIAEASSKGREAFKKQRESRLADTQPWPTFADEVKARRAFVVPTRMADHG

SEQ ID NO: 2523 - protein, 137 aa, Unknown; identical to SEQ ID NO: 2509
  Description of Unknown: uncultivated organism with predicted taxonomy: Coriobacteriia
  MG14-26 RuvC-III domain

SEQ ID NO: 2524 - protein, 137 aa, Unknown; identical to SEQ ID NO: 2509
  Description of Unknown: uncultivated organism with predicted taxonomy: Collinsella
  MG14-27 RuvC-III domain

SEQ ID NO: 2525 - protein, 126 aa, Unknown
  Description of Unknown: uncultivated organism with predicted taxonomy: Collinsella
  MG14-28 RuvC-III domain
NDTRYMSKDVAKWLTDCLPFPEDGRKHVFCVSGVATALMRGIWRIGILDDDGKKNREDDRHHAVDAAVIAACTPSIVRGIALISEEHATHRDADRLLNRSLPYPEYRDQVKAWIPCIVPTYSPNRT

SEQ ID NO: 2526 - protein, 137 aa, Unknown; identical to SEQ ID NO: 2509
  Description of Unknown: uncultivated organism with predicted taxonomy: Coriobacteriales
  MG14-29 RuvC-III domain

SEQ ID NO: 2527 - protein, 137 aa, Unknown; identical to SEQ ID NO: 2509
  Description of Unknown: uncultivated organism with predicted taxonomy: Collinsella
  MG14-30 RuvC-III domain

SEQ ID NO: 2528 - protein, 123 aa, Unknown
  Description of Unknown: uncultivated organism with predicted taxonomy: Coriobacteriia bacterium
  MG14-31 RuvC-III domain
NDTRYASLAAKRYIEEYLTFKDNGKSRHVIAVAGGATAALRNAWGIRKDRSEDNLHHAVDASIIAACDESTVIAIAKASERKALTPKDKRKELFSRTEPWQDFANEVLSRKEHIIPSFMTDHK

SEQ ID NO: 2529 - protein, 128 aa, Unknown
  Description of Unknown: uncultivated organism with predicted taxonomy: Olsenella sp. KH3B4
  MG14-32 RuvC-III domain
NDDRYMSVAVKNYLEDCLLFPEDGRKRHVTAVAGGATGNLRWVWGLNFGEGNVKDRADDRHHAIDAAIIAACSESTVKKVAEASTKGREAFKQLRKSRLADTQPWPTFATEVAARREFVVPTRMADHG

SEQ ID NO: 2530 - protein, 137 aa, Unknown; identical to SEQ ID NO: 2509
  Description of Unknown: uncultivated organism with predicted taxonomy: Collinsella
  MG14-33 RuvC-III domain

SEQ ID NO: 2531 - protein, 128 aa, Unknown; identical to SEQ ID NO: 2505
  Description of Unknown: uncultivated organism with predicted taxonomy: Olsenella
  MG14-34 RuvC-III domain

SEQ ID NO: 2532 - protein, 128 aa, Unknown
  Description of Unknown: uncultivated organism with predicted taxonomy: Olsenella sp. KH3B4
  MG14-35 RuvC-III domain
NDDRYMSVAVKNYLEDCLLFPDSDRKRHVTAIAGGATGNLRWVWGLNSGSNNTKDRSDDRHHAVDAAVIAACSEATVQKVARARSLGRETFKHMRKSRLADTQPWPTFADEVIARKEFVIPTRMADHG

SEQ ID NO: 2533 - protein, 137 aa, Unknown
  Description of Unknown: uncultivated organism with predicted taxonomy: Coriobacteriales
  MG14-36 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRK

SEQ ID NO: 2534 - protein, 126 aa, Unknown
  Description of Unknown: uncultivated organism with predicted taxonomy: Coprococcus comes
  MG14-37 RuvC-III domain
NDTRYMSRQLAMWVRECLPFPDDRRQHVFCVAGAATSLMRRIWGIGIVDEKGKKDRSDDRHHAVDAAVIACCSPEIVKGIARVNSGRSNIKERERLRYESMPYPEFKAQVEAWIPCIVPTRTVSRT

SEQ ID NO: 2535 - protein, 137 aa, Unknown
  Description of Unknown: uncultivated organism with predicted taxonomy: Coriobacteriia bacterium
  MG14-38 RuvC-III domain
TDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENVMPWETFANEVRVAHDFVVPTRFVPRK

SEQ ID NO: 2536 - protein, 137 aa, Unknown; identical to SEQ ID NO: 2533
  Description of Unknown: uncultivated organism with predicted taxonomy: Collinsella
  MG14-39 RuvC-III domain

SEQ ID NO: 2537 - protein, 126 aa, Unknown
  Description of Unknown: uncultivated organism
  MG14-40 RuvC-III domain
NDTRYMSRQLAMWVRECLPFPDDKRQHVFCVAGAATSLMRRIWGIGVVDEKGKTDRSDDRHHAVDGAVIACCSPEIVKGIARVNSGRSNIKERERLRYESMPYPEFKDQVEAWIPCIVPTRTVSRT

SEQ ID NO: 2538 - protein, 137 aa, Unknown
  Description of Unknown: uncultivated organism with predicted taxonomy: Collinsella
  MG14-41 RuvC-III domain
TDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRK

SEQ ID NO: 2539 - protein, 137 aa, Unknown; identical to SEQ ID NO: 2533
  Description of Unknown: uncultivated organism with predicted taxonomy: Collinsella
  MG14-42 RuvC-III domain

SEQ ID NO: 2540 - protein, 137 aa, Unknown
  Description of Unknown: uncultivated organism with predicted taxonomy: Collinsella
  MG14-43 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRK

SEQ ID NO: 2541 - protein, 137 aa, Unknown
  Description of Unknown: uncultivated organism with predicted taxonomy: Olsenella mediterranea
  MG14-44 RuvC-III domain
TDTAYMSREVCAYLADCLQFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRK

SEQ ID NO: 2542 - protein, 137 aa, Unknown; identical to SEQ ID NO: 2538
  Description of Unknown: uncultivated organism with predicted taxonomy: Collinsella
  MG14-45 RuvC-III domain

SEQ ID NO: 2543 - protein, 137 aa, Unknown; identical to SEQ ID NO: 2533
  Description of Unknown: uncultivated organism with predicted taxonomy: Collinsella
  MG14-46 RuvC-III domain

SEQ ID NO: 2544 - protein, 126 aa, Unknown
  Description of Unknown: uncultivated organism with predicted taxonomy: Collinsella sp. AM13-34
  MG14-47 RuvC-III domain
NDTRYMSVALAKWLRECLPFARDGHEHVFRVAGGATALMRSVWDIGITGPDGKKNRDDDRHHAVDAAVISCCTPGIVKNVALVNEGHARADVRQRLFRDSLPYPEFKEQVNAWIPCIVPTLTLPNT

SEQ ID NO: 2545 - protein, 137 aa, Unknown
  Description of Unknown: uncultivated organism with predicted taxonomy: Collinsella
  MG14-48 RuvC-III domain
TDTAYMSREVCAYLADCLLFPDDGAKAHVVPTTGRATAWLRRRWGLNFGSNGEKDRSDDRHHATDACVIAACSRSLVIKTARINQETHRSITRGMNETQRRDAIMKALESVMPWETFANEVRAAHDFVVPTRFVPRK

SEQ ID NO: 2546 - protein, 126 aa, Unknown
  Description of Unknown: uncultivated organism with predicted taxonomy: Collinsella sp. AF20-14LB
  MG14-49 RuvC-III domain
NDTRYMSRQLAMWVRECLPFPDDKRQHVFCVAGAATSLMRRIWGIGIVDEKGKKDRSDDRHHAVDAAVIACCSPEIVKGIARVNSGRSNIKERERLRYESMPYPEFKAQVEAWIPCIVPTRTVSRT

SEQ ID NO: 2547 - protein, 128 aa, Unknown
  Description of Unknown: uncultivated organism with predicted taxonomy: Libanicoccus massiliensis
  MG14-50 RuvC-III domain
NDTRYMSRAVKSYLEDCLIFPKGKREKHVTAVAGGATGNLRWVWGLNFGAHGEKNRKDDRHHAVDAAVIAACNESAVMKVAKTTSMGREQFRKERKARLSNTQPWPTFADEVAAIRELVIPTRMVSHG

SEQ ID NO: 2548 - protein, 137 aa, Unknown; identical to SEQ ID NO: 2533
  Description of Unknown: uncultivated organism with predicted taxonomy: Collinsella
  MG14-51 RuvC-III domain

SEQ ID NO: 2549 - protein, 137 aa, Unknown
  Description of Unknown: uncultivated organism with predicted taxonomy: Collinsella
  MG14-52 RuvC-III domain
TDTAYMSREVCAYLADCLLFPDDGAKAHVVPTTGRATAWLRRRWGLNFGLTGEKDRSDDRHHATDACVIAACSPSLVIKTAQINQKMHWSMTKGMSKAQRQDAIMKALENVMPWETFANEVRAVHKLIIPTRLVPRK

SEQ ID NO: 2550 - protein, 128 aa, Unknown
  Description of Unknown: uncultivated organism with predicted taxonomy: Olsenella sp. KH3B4
  MG14-53 RuvC-III domain
NDDRYMSVAVKNYLEDCLLFPEDGRKRHVTAVAGGATGNLRWVWGLNFGSGNVKDRDDDRHHAVDAAIIAACSEGTVQKVAKASSKGREAFKHLRESRLADTQPWPTFADEVIARREFVVPTRMVDHG

SEQ ID NO: 2551 - protein, 128 aa, Unknown
  Description of Unknown: uncultivated organism with predicted taxonomy: Olsenella sp. KH3B4
  MG14-54 RuvC-III domain
NDDRYMSVAVKNFLEDRLLFPEDGRKRHVTAVAGGATGNLRWVWGLNFGEGNIKDRTDDRHHAVDAAIIAACSESTVKKVAKASAKAREAFKQLRKSRLADTQPWPTFAAEVAARREFVVPTRMADHG

SEQ ID NO: 2552 - protein, 126 aa, Unknown
  Description of Unknown: uncultivated organism with predicted taxonomy: Collinsella
  MG14-55 RuvC-III domain
NDTRYMSKDVAKWLADCLPFPEDGRKHVFCVSGAATAFMRGIWRIGILDDVGKKNREDDRHYAVDAAVIAACTSSIVKGIALISEEHATNRDADRLLDGSLPYPEYRDQVKAWIPCIVPTYSPTRT

SEQ ID NO: 2553 - protein, 137 aa, Unknown
  Description of Unknown: uncultivated organism with predicted taxonomy: Collinsella
  MG14-56 RuvC-III domain
TDTAYMSREVCAYLADCLLFPNDGAKAHVVPTTGRATAWLRRRWGLNFGLTGEKDRSDDRHHATDACVIAACSPSLVIKTAQINQKMHWSMTKGMSKAQRQDAIMKALENVMPWETFANEVRAVHKLIIPTRFVPRK

SEQ ID NO: 2554 - protein, 128 aa, Unknown
  Description of Unknown: uncultivated organism with predicted taxonomy: Olsenella
  MG14-57 RuvC-III domain
NDDRYMSVAVKNFLEDRLLFPEDGRKRHVTAVAGGATGSLRWVWGLNFGEGNIKDRTDDRHHAVDAAIIAACSESTVKKVAEASAKGREAFKQLRKSRLADTQPWPSFAAEAAARREFVVPTRMADHG

SEQ ID NO: 2555 - protein, 137 aa, Unknown; identical to SEQ ID NO: 2533
  Description of Unknown: uncultivated organism with predicted taxonomy: Collinsella
  MG14-58 RuvC-III domain

SEQ ID NO: 2556 - protein, 137 aa, Unknown; identical to SEQ ID NO: 2535
  Description of Unknown: uncultivated organism with predicted taxonomy: Collinsella
  MG14-59 RuvC-III domain

SEQ ID NO: 2557 - protein, 137 aa, Unknown; identical to SEQ ID NO: 2553
  Description of Unknown: uncultivated organism with predicted taxonomy: Collinsella
  MG14-60 RuvC-III domain

SEQ ID NO: 2558 - protein, 137 aa, Unknown; identical to SEQ ID NO: 2533
  Description of Unknown: uncultivated organism with predicted taxonomy: Collinsella
  MG14-61 RuvC-III domain

SEQ ID NO: 2559 - protein, 137 aa, Unknown
  Description of Unknown: uncultivated organism with predicted taxonomy: Collinsella
  MG14-62 RuvC-III domain
TDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALENVMPWETFANEVRAAHDFVVPTRFVPRK

SEQ ID NO: 2560 - protein, 126 aa, Unknown
  Description of Unknown: uncultivated organism with predicted taxonomy: Collinsella
  MG14-63 RuvC-III domain
NDTRYMSVALAKWLMECLPFAKDGHEHVFCVAGGATALMRSVWNIGITGPDGKKNRDDDRHHAVDAAVIACCTPGIVKNVALVNEGHARADVRQRLFRDSLPYPEFKEQVDAWIPCIVPTLTLPST

SEQ ID NO: 2561 - protein, 137 aa, Unknown
  Description of Unknown: uncultivated organism with predicted taxonomy: Collinsella
  MG14-64 RuvC-III domain
TDTAYMSREVCAYLADCLLFPEDGTKSHVVPTTGRATAWLRRRWGLNFGINGEKDRSDDRHHATDACVIAACSRSLVIKTAKISEQTHWAVTKDLDKDERDHLRMKALENVMPWETFANEVRASHDFVIPTRFVPHK

SEQ ID NO: 2562 - protein, 137 aa, Unknown; identical to SEQ ID NO: 2553
  Description of Unknown: uncultivated organism with predicted taxonomy: Collinsella
  MG14-65 RuvC-III domain

SEQ ID NO: 2563 - protein, 137 aa, Unknown
  Description of Unknown: uncultivated organism with predicted taxonomy: Collinsella
  MG14-66 RuvC-III domain
TDTAYMSREACAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRK

SEQ ID NO: 2564 - protein, 137 aa, Unknown; identical to SEQ ID NO: 2533
  Description of Unknown: uncultivated organism with predicted taxonomy: Collinsella
  MG14-67 RuvC-III domain

SEQ ID NO: 2565 - protein, 137 aa, Unknown; identical to SEQ ID NO: 2533
  Description of Unknown: uncultivated organism with predicted taxonomy: Collinsella
  MG14-68 RuvC-III domain

SEQ ID NO: 2566 - protein, 128 aa, Unknown
  Description of Unknown: uncultivated organism with predicted taxonomy: Olsenella
  MG14-69 RuvC-III domain
NDDRYMSREVKSYLEDTLIFPEDGRVKHVIAVAGGATGSLRHVWGLNFGANNSKDRSDNRHHAIDACVIAACSESTLQAVAKARKLGAETYKRMRKDRLKDTQPWPTFADEVIARREFVIPTHMVSHG

SEQ ID NO: 2567 - protein, 137 aa, Unknown
  Description of Unknown: uncultivated organism with predicted taxonomy: Collinsella tanakaei
  MG14-70 RuvC-III domain
TDTAYMSREVCAYLSDCLQFPDDGLKNHIVPIAGRATAWLRRQWGLNFGATGEKDRSDDRHHATDACVIAACSRSLVIKTAKVMKQTHWQVTRDMTREQRRSARMKALEGTMPWSTFANEVRERWKVTVPTRFVPRK

SEQ ID NO: 2568 - protein, 137 aa, Unknown
  Description of Unknown: uncultivated organism with predicted taxonomy: Collinsella
  MG14-71 RuvC-III domain
TDTAYMSREVCAYLADCLLFPDDGAKAHVVPTTGRATAWLRRRWGLNFGSNGEKDRSDDRHHATDACVISACSRSLVIKTARINQETHWSITRGMNETQRRDAIMKALESVMPWETFANEVRAAHDFVVPTRFVPRK

SEQ ID NO: 2569 - protein, 123 aa, Unknown
  Description of Unknown: uncultivated organism with predicted taxonomy: Atopobium sp. ICM42b
  MG14-72 RuvC-III domain
VDTQYMARAISAWLSDSLNFSTEFNQKQHVYAVNGRMTAKLRRKWGLNFGEDDTKDRSDNRHHAIDAAVIAVCSASMVKEFAISYSRLREVRDSVIAEPWEGFADQVREAREWVIPTMYRPNK

SEQ ID NO: 2570 - protein, 137 aa, Unknown; identical to SEQ ID NO: 2533
  Description of Unknown: uncultivated organism with predicted taxonomy: Collinsella
  MG14-73 RuvC-III domain

SEQ ID NO: 2571 - protein, 126 aa, Unknown
  Description of Unknown: uncultivated organism with predicted taxonomy: Collinsella
  MG14-74 RuvC-III domain
NDTRYMSKDVAKWLADCLPFPEDGRKHIFCVSGAATAFMRGIWRIGILDDAGKKNREDDRHYAVDAAVIAACTSSIVKDIALISEEHATNRDADRLLDGSLPYPEYRDQVKAWIPCIVPTYSPTRT

SEQ ID NO: 2572 - protein, 126 aa, Unknown
  Description of Unknown: uncultivated organism with predicted taxonomy: Collinsella sp. AM13-34
  MG14-75 RuvC-III domain
NDTRYMSVALAKWLRECLPFAKDGHEHVFCVAGGATALMRSVWNIGITGPDGKKNREDDRHHAVDAAVIACCTPGIVRNVALVNEGHARADVRQRLFSDSLPYPEFKEQVDAWIPCIVPTLTLPNA

SEQ ID NO: 2573 - protein, 137 aa, Unknown; identical to SEQ ID NO: 2533
  Description of Unknown: uncultivated organism with predicted taxonomy: Collinsella
  MG14-76 RuvC-III domain

SEQ ID NO: 2574 - protein, 137 aa, Unknown; identical to SEQ ID NO: 2499
  Description of Unknown: uncultivated organism with predicted taxonomy: Collinsella
  MG14-77 RuvC-III domain

SEQ ID NO: 2575 - protein, 137 aa, Unknown
  Description of Unknown: uncultivated organism with predicted taxonomy: Collinsella
  MG14-78 RuvC-III domain
TDTAYMSREVCAYLADCLLFPDDGAKAHVVPTTGRATAWLRRRWELNFGSNREKDRSDDRHHATDACVIAACSRSLVIKTARINQETHWSITRGMNETQRRDAIMKALESVMPWETFANEVRAAHDFVVPTRFVPRK

SEQ ID NO: 2576 - protein, 137 aa, Unknown; identical to SEQ ID NO: 2533
  Description of Unknown: uncultivated organism with predicted taxonomy: Collinsella
  MG14-79 RuvC-III domain

SEQ ID NO: 2577 - protein, 137 aa, Unknown; identical to SEQ ID NO: 2499
  Description of Unknown: uncultivated organism with predicted taxonomy: Coriobacteriales
  MG14-80 RuvC-III domain

SEQ ID NO: 2578 - protein, 137 aa, Unknown
  Description of Unknown: uncultivated organism with predicted taxonomy: Collinsella
  MG14-82 RuvC-III domain
TDTAYMSREVCAYLADCLLFPDDGAKAHVVPTTGRATAWLRRRWGLNFGSNREKDRSDDRHHATDACVIAACSRSLVIKTARINQETHWSITRGMNETQRRNAIMKALESVMPWETFANEVRAAHDFVVPTRFVPRK

SEQ ID NO: 2579 - protein, 137 aa, Unknown; identical to SEQ ID NO: 2507
  Description of Unknown: uncultivated organism with predicted taxonomy: Collinsella
  MG14-83 RuvC-III domain

SEQ ID NO: 2580 - protein, 128 aa, Unknown; identical to SEQ ID NO: 2505
  Description of Unknown: uncultivated organism with predicted taxonomy: Olsenella
  MG14-84 RuvC-III domain

SEQ ID NO: 2581 - protein, 137 aa, Unknown; identical to SEQ ID NO: 2540
  Description of Unknown: uncultivated organism with predicted taxonomy: Collinsella
  MG14-85 RuvC-III domain

SEQ ID NO: 2582 - protein, 137 aa, Unknown; identical to SEQ ID NO: 2538
  Description of Unknown: uncultivated organism with predicted taxonomy: Collinsella
  MG14-87 RuvC-III domain

SEQ ID NO: 2583 - protein, 137 aa, Unknown; identical to SEQ ID NO: 2538
  Description of Unknown: uncultivated organism with predicted taxonomy: Collinsella
  MG14-88 RuvC-III domain

SEQ ID NO: 2584 - protein, 137 aa, Unknown; identical to SEQ ID NO: 2533
  Description of Unknown: uncultivated organism with predicted taxonomy: Collinsella
  MG14-89 RuvC-III domain

SEQ ID NO: 2585 - protein, 137 aa, Unknown
  Description of Unknown: uncultivated organism with predicted taxonomy: Coriobacteriia
  MG14-90 RuvC-III domain
TDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENAMPWETFANEVRVAHDFVVPTRFVPRK

SEQ ID NO: 2586 - protein, 137 aa, Unknown; identical to SEQ ID NO: 2567
  Description of Unknown: uncultivated organism with predicted taxonomy: Collinsella tanakaei
  MG14-91 RuvC-III domain

SEQ ID NO: 2587 - protein, 137 aa, Unknown; identical to SEQ ID NO: 2541
  Description of Unknown: uncultivated organism with predicted taxonomy: Collinsella
  MG14-92 RuvC-III domain

SEQ ID NO: 2588 - protein, 137 aa, Unknown; identical to SEQ ID NO: 2538
  Description of Unknown: uncultivated organism with predicted taxonomy: Collinsella
  MG14-93 RuvC-III domain

SEQ ID NO: 2589 - protein, 137 aa, Unknown; identical to SEQ ID NO: 2533
  Description of Unknown: uncultivated organism with predicted taxonomy: Collinsella
  MG14-94 RuvC-III domain

SEQ ID NO: 2590 - protein, 126 aa, Unknown
  Description of Unknown: uncultivated organism with predicted taxonomy: Collinsella
  MG14-95 RuvC-III domain
NDTRYMSVALAKWLRECLPFTKDGHEHVFCVAGGATALMRSVWDIGITGPDGKKNRDDDRHHAVDAAVIACCTPGIVKNVALVNEGHARADVRQRLFSDSLPYPEFKEQVDAWISCIVPTLTLPNT

SEQ ID NO: 2591 - protein, 137 aa, Unknown
  Description of Unknown: uncultivated organism with predicted taxonomy: Collinsella
  MG14-96 RuvC-III domain
TDTAYMSREVCAYLADCLLFPDDGAKAHVVPTTGRATAWLRRRWGLNFGSNGEKDRSDNRHHATDACVIAACSRSLVIKTARINQETHWSITRGMNETQRRDAIMKALESVMPWETFANEVRAAHDFVVPTRFVPRK

SEQ ID NO: 2592 - protein, 137 aa, Unknown; identical to SEQ ID NO: 2533
  Description of Unknown: uncultivated organism with predicted taxonomy: Collinsella
  MG14-97 RuvC-III domain

SEQ ID NO: 2593 - protein, 137 aa, Unknown
  Description of Unknown: uncultivated organism with predicted taxonomy: Collinsella
  MG14-98 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSITRGMNEAQRRDAIMKALESVMPWETFANEVRAAHDFVVPTRFVPRK

SEQ ID NO: 2594 - protein, 128 aa, Unknown; identical to SEQ ID NO: 2506
  Description of Unknown: uncultivated organism with predicted taxonomy: Olsenella
  MG14-99 RuvC-III domain

SEQ ID NO: 2595 - protein, 137 aa, Unknown; identical to SEQ ID NO: 2533
  Description of Unknown: uncultivated organism with predicted taxonomy: Collinsella
  MG14-100 RuvC-III domain

SEQ ID NO: 2596 - protein, 126 aa, Unknown
  Description of Unknown: uncultivated organism with predicted taxonomy: Eggerthella sp. AM16-19
  MG14-101 RuvC-III domain
NDTRYMSVALAKWLRECLPFARDGHEHVFCVAGGATALMRSVWNIGITGPDGKKNRDDDRHHAVDAAVIACCTPGIVKNVALVNEGHARADVRQRLFRDSLPYPEFKEQVNAWIPCIVPTLTLPNT

SEQ ID NO: 2597 - protein, 128 aa, Unknown
  Description of Unknown: uncultivated organism with predicted taxonomy: Olsenella sp. KH3B4
  MG14-102 RuvC-III domain
NDDRYMSVAVKNFLEDRLLFPEDGRKRHVTAVAGGATGNLRWVWGLNFGEGNIKDRTDDRHHAVDAAIIAACSESTVKKVAKASAKGREAFKQLRKSRLADTQPWPTFAAEVAARREFVVPTRMADHG

SEQ ID NO: 2598 - protein, 137 aa, Unknown; identical to SEQ ID NO: 2538
  Description of Unknown: uncultivated organism with predicted taxonomy: Collinsella
  MG14-103 RuvC-III domain

SEQ ID NO: 2599 - protein, 137 aa, Unknown; identical to SEQ ID NO: 2538
  Description of Unknown: uncultivated organism with predicted taxonomy: Collinsella
  MG14-104 RuvC-III domain

SEQ ID NO: 2600 - protein, 137 aa, Unknown; identical to SEQ ID NO: 2509
  Description of Unknown: uncultivated organism with predicted taxonomy: Collinsella
  MG14-105 RuvC-III domain

SEQ ID NO: 2601 - protein, 137 aa, Unknown; identical to SEQ ID NO: 2549
  Description of Unknown: uncultivated organism with predicted taxonomy: Collinsella
  MG14-106 RuvC-III domain

SEQ ID NO: 2602 - protein, 137 aa, Unknown; identical to SEQ ID NO: 2499
  Description of Unknown: uncultivated organism with predicted taxonomy: Collinsella
  MG14-107 RuvC-III domain

SEQ ID NO: 2603 - protein, 123 aa, Unknown
  Description of Unknown: uncultivated organism with predicted taxonomy: Atopobium sp. ICM42b
  MG14-108 RuvC-III domain
VDTQYMARAISAWLSDSLNFSSEFDQKQHVYAVNGRMTAKLRRKWGLNFGEDDTKDRSDNRHHAIDAAVIAACSASMVKEFAISYSRLREVRDSVIAEPWEGFADQVREAREWIIPTMYRPNK

SEQ ID NO: 2604 - protein, 123 aa, Unknown
  Description of Unknown: uncultivated organism with predicted taxonomy: Atopobium sp. ICM42b
  MG14-109 RuvC-III domain
SDTQYMSKAIVAWLSDSLDFPSRYGQKQHVYATNGRMTSKLRKEWGLNFGENGIKDRNDKRHHAVDAAVIAACSASMVKEFATSYSRSHETKNSTIAEPWEGFADQVREAREWVIPTMYRPNK

SEQ ID NO: 2605 - protein, 137 aa, Unknown; identical to SEQ ID NO: 2538
  Description of Unknown: uncultivated organism with predicted taxonomy: Collinsella
  MG14-110 RuvC-III domain

SEQ ID NO: 2606 - protein, 126 aa, Unknown
  Description of Unknown: uncultivated organism
  MG14-111 RuvC-III domain
NDTRYMSRQLAMWVRECLPFPDDKRQHVFCVAGAATSLMRRIWGIGIVDEKGKKDRSDDRHHAVDAAVIACCDQRIVKGIARVNSGRSNIKERERLRYESMPYPEFKAQVEAWIPCIVPTRTVSRT

SEQ ID NO: 2607 - protein, 137 aa, Unknown
  Description of Unknown: uncultivated organism with predicted taxonomy: Collinsella
  MG14-112 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSITRGMNETQRRGAIMKALESVMPWETFANEVRAAHGFVVPTRFVPRK

SEQ ID NO: 2608 - protein, 137 aa, Unknown; identical to SEQ ID NO: 2533
  Description of Unknown: uncultivated organism with predicted taxonomy: Collinsella
  MG14-113 RuvC-III domain

SEQ ID NO: 2609 - protein, 137 aa, Unknown
  Description of Unknown: uncultivated organism with predicted taxonomy: Collinsella
  MG14-114 RuvC-III domain
TDTAYMSREVCAYLADCLLFPDDGAKAHVVPTTGRATAWLRRRWGLNFGSNGEKDRSDDRHHATDACVIAACSRSLVIKTARINQEAHWSITRGMNETQRRDAIMKALESVMPWETFANEVRAAHDFVVPTRFVPRK

SEQ ID NO: 2610 - protein, 137 aa, Unknown; identical to SEQ ID NO: 2540
  Description of Unknown: uncultivated organism with predicted taxonomy: Collinsella
  MG14-115 RuvC-III domain

SEQ ID NO: 2611 - protein, 137 aa, Unknown
  Description of Unknown: uncultivated organism with predicted taxonomy: Collinsella
  MG14-116 RuvC-III domain
TDTAYMSREVCAYLADCLLFPDDGAKAHVVPTTGRATAWLRRRWGLNFGSDGEKDRSDDRHHATDACVIAACSPSLVIKTARINQETHWSITRGMNETQRRDAIMKALESVMPWETFANEVRAAHDFVVPTRFVPRK

SEQ ID NO: 2612 - protein, 137 aa, Unknown; identical to SEQ ID NO: 2545
  Description of Unknown: uncultivated organism with predicted taxonomy: Collinsella
  MG14-117 RuvC-III domain

SEQ ID NO: 2613 - protein, 128 aa, Unknown
  Description of Unknown: uncultivated organism with predicted taxonomy: Olsenella sp. KCTC 15699
  MG14-118 RuvC-III domain
NDDRYMSVAVKNYLEDCLLFPEDGHKRHVTAVAGGATGNLRWVWGLNFGEGNVKNRADDRHHAVDAAIIAACSESTVKKVAEASAKGREAFKQLRKSRLADTQPWPTFAAEVAARREFVVPTRMADHG

SEQ ID NO: 2614 - protein, 137 aa, Unknown
  Description of Unknown: uncultivated organism with predicted taxonomy: Collinsella
  MG14-119 RuvC-III domain
TDTAYMSREVCTYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRK

SEQ ID NO: 2615 - protein, 137 aa, Unknown; identical to SEQ ID NO: 2567
  Description of Unknown: uncultivated organism with predicted taxonomy: Collinsella tanakaei
  MG14-120 RuvC-III domain

SEQ ID NO: 2616 - protein, 137 aa, Unknown
  Description of Unknown: uncultivated organism with predicted taxonomy: Collinsella
  MG14-121 RuvC-III domain
TDTAYMSREVCAYLADCLLFPDDGAKAHVVPTTGRATAWLRRRWGLNFGSNGEKDRLDDRHHATDACVIAACSRSLVIKTARINQETHWSITRGMNEAQRRDAIMKALESVMPWETFANEVRAAHDFVVPTRFVPRK

SEQ ID NO: 2617 - protein, 128 aa, Unknown
  Description of Unknown: uncultivated organism with predicted taxonomy: Olsenella
  MG14-122 RuvC-III domain
NDDRYMSVAVKNYLEDCLLFPEDGRKRHVTAVAGGATGNLRWVWGLNFGEGNVKDRADDRHHAVDAAIIAACSESTVKKVAEASAKGREAFKQLRKSRLADTQPWPTFAAEVAARREFVVPTRMADHG

SEQ ID NO: 2618 - protein, 137 aa, Unknown; identical to SEQ ID NO: 2533
  Description of Unknown: uncultivated organism with predicted taxonomy: Olsenella mediterranea
  MG14-123 RuvC-III domain

SEQ ID NO: 2619 - protein, 137 aa, Unknown; identical to SEQ ID NO: 2533
  Description of Unknown: uncultivated organism with predicted taxonomy: Collinsella
  MG14-124 RuvC-III domain

SEQ ID NO: 2620 - protein, 137 aa, Unknown; identical to SEQ ID NO: 2533
  Description of Unknown: uncultivated organism with predicted taxonomy: Collinsella
  MG14-125 RuvC-III domain

SEQ ID NO: 2621 - protein, 128 aa, Unknown; identical to SEQ ID NO: 2547
  Description of Unknown: uncultivated organism with predicted taxonomy: Libanicoccus massiliensis
  MG14-126 RuvC-III domain

SEQ ID NO: 2622 - protein, 137 aa, Unknown; identical to SEQ ID NO: 2533
  Description of Unknown: uncultivated organism with predicted taxonomy: Collinsella
  MG14-127 RuvC-III domain

SEQ ID NO: 2623 - protein, 137 aa, Unknown; identical to SEQ ID NO: 2538
  Description of Unknown: uncultivated organism with predicted taxonomy: Collinsella
  MG14-128 RuvC-III domain

SEQ ID NO: 2624 - protein, 137 aa, Unknown; identical to SEQ ID NO: 2533
  Description of Unknown: uncultivated organism with predicted taxonomy: Collinsella
  MG14-129 RuvC-III domain

SEQ ID NO: 2625 - protein, 79 aa, Unknown
  Description of Unknown: uncultivated organism with predicted taxonomy: Olsenella sp. KH3B4
  MG14-130 RuvC-III domain
NDDRYMSVAVKNYLEDCLLFPEDGRKRHVTAVAGGATGNLRWVWGLNFGEGNVKDRADDRHHAIDAAIIAACSESTVKK

SEQ ID NO: 2626 - protein, 137 aa, Unknown; identical to SEQ ID NO: 2538
  Description of Unknown: uncultivated organism with predicted taxonomy: Collinsella
  MG14-131 RuvC-III domain

SEQ ID NO: 2627 - protein, 137 aa, Unknown; identical to SEQ ID NO: 2533
  Description of Unknown: uncultivated organism with predicted taxonomy: Collinsella
  MG14-132 RuvC-III domain

SEQ ID NO: 2628 - protein, 137 aa, Unknown; identical to SEQ ID NO: 2533
  Description of Unknown: uncultivated organism with predicted taxonomy: Collinsella
  MG14-133 RuvC-III domain

SEQ ID NO: 2629 - protein, 137 aa, Unknown; identical to SEQ ID NO: 2533
  Description of Unknown: uncultivated organism with predicted taxonomy: Collinsella
  MG14-135 RuvC-III domain

SEQ ID NO: 2630 - protein, 137 aa, Unknown
  Description of Unknown: uncultivated organism with predicted taxonomy: Collinsella
  MG14-136 RuvC-III domain
TDTAYMSREVCAYLADCLLFPDDGAKAHVVPTTGRATAWLRRRWGLNFGSNREKDCSDDRHHATDACVIAACSRSLVIKTARINQETHWSITRGMNETQRRNAIMKALESVMPWETFANEVRAAHDFVVPTRFVPRK

SEQ ID NO: 2631 - protein, 126 aa, Unknown; identical to SEQ ID NO: 2606
  Description of Unknown: uncultivated organism with predicted taxonomy: Clostridiales
  MG14-137 RuvC-III domain

SEQ ID NO: 2632 - protein, 137 aa, Unknown; identical to SEQ ID NO: 2499
  Description of Unknown: uncultivated organism with predicted taxonomy: Collinsella
  MG14-138 RuvC-III domain

SEQ ID NO: 2633 - protein, 137 aa, Unknown; identical to SEQ ID NO: 2538
  Description of Unknown: uncultivated organism with predicted taxonomy: Collinsella
  MG14-139 RuvC-III domain

SEQ ID NO: 2634 - protein, 137 aa, Unknown; identical to SEQ ID NO: 2533
  Description of Unknown: uncultivated organism with predicted taxonomy: Collinsella
  MG14-140 RuvC-III domain

SEQ ID NO: 2635 - protein, 128 aa, Unknown; identical to SEQ ID NO: 2551
  Description of Unknown: uncultivated organism with predicted taxonomy: Olsenella sp. KH3B4
  MG14-141 RuvC-III domain

SEQ ID NO: 2636 - protein, 137 aa, Unknown; identical to SEQ ID NO: 2541
  Description of Unknown: uncultivated organism with predicted taxonomy: Collinsella
  MG14-142 RuvC-III domain

SEQ ID NO: 2637 - protein, 137 aa, Unknown; identical to SEQ ID NO: 2533
  Description of Unknown: uncultivated organism with predicted taxonomy: Collinsella
  MG14-143 RuvC-III domain

SEQ ID NO: 2638 - protein, 126 aa, Unknown
  Description of Unknown: uncultivated organism with predicted taxonomy: Collinsella
  MG14-144 RuvC-III domain
NDTRYMSVALAKWLRECLPFARDGHEHVFCVAGGATALMRSVWDIGITGPDGKKNRDDDRHHAVDAAVIACCTPGIVKNVALVNEGHARADVRQRLFRDSLPYPEFKEQVNAWIPCIVPTLTLPNT

SEQ ID NO: 2639 - protein, 128 aa, Unknown; identical to SEQ ID NO: 2505
  Description of Unknown: uncultivated organism with predicted taxonomy: Olsenella sp. KCTC 15699
  MG14-145 RuvC-III domain

SEQ ID NO: 2640 - protein, 128 aa, Unknown
  Description of Unknown: uncultivated organism with predicted taxonomy: Olsenella
  MG14-146 RuvC-III domain
NDDRYMSVAVKNYLEDCLLFPEDGRKRHVTAVAGGATGNLRWVWGLNFGEGNIKDRTDDRHHAVDAAIIAACSESTVKKVAEASAKGREAFKQLRKSRLADTQPWPTFAAEVAARREFVVPTHMANHG

SEQ ID NO: 2641 - protein, 128 aa, Unknown; identical to SEQ ID NO: 2532
  Description of Unknown: uncultivated organism with predicted taxonomy: Olsenella sp. KH3B4
  MG14-147 RuvC-III domain

SEQ ID NO: 2642 - protein, 137 aa, Unknown; identical to SEQ ID NO: 2533
  Description of Unknown: uncultivated organism with predicted taxonomy: Olsenella mediterranea
  MG14-148 RuvC-III domain

SEQ ID NO: 2643 - protein, 137 aa, Unknown; identical to SEQ ID NO: 2538
  Description of Unknown: uncultivated organism with predicted taxonomy: Collinsella
  MG14-149 RuvC-III domain

SEQ ID NO: 2644 - protein, 137 aa, Unknown
  Description of Unknown: uncultivated organism with predicted taxonomy: Collinsella
  MG14-150 RuvC-III domain
TDTAYMSREVCAYLADCLLFPDDGAKAHVVPTTGRATAWLRRRWGLNFGSNGEKDRSDDRHHATDACVIAACNRSLVIKTARINQETHWSITRGMNETQRRDAIMKALESVMPWETFANEVRAAHDFVVPTRFVPRK

SEQ ID NO: 2645 - protein, 137 aa, Unknown; identical to SEQ ID NO: 2538
  Description of Unknown: uncultivated organism with predicted taxonomy: Collinsella
  MG14-151 RuvC-III domain

SEQ ID NO: 2646 - protein, 137 aa, Unknown; identical to SEQ ID NO: 2509
  Description of Unknown: uncultivated organism with predicted taxonomy: Collinsella
  MG14-152 RuvC-III domain

SEQ ID NO: 2647 - protein, 137 aa, Unknown; identical to SEQ ID NO: 2509
  Description of Unknown: uncultivated organism with predicted taxonomy: Coriobacteriales
  MG14-153 RuvC-III domain

SEQ ID NO: 2648 - protein, 128 aa, Unknown; identical to SEQ ID NO: 2554
  Description of Unknown: uncultivated organism with predicted taxonomy: Olsenella
  MG14-154 RuvC-III domain

SEQ ID NO: 2649 - protein, 128 aa, Unknown; identical to SEQ ID NO: 2505
  Description of Unknown: uncultivated organism with predicted taxonomy: Olsenella
  MG14-155 RuvC-III domain

SEQ ID NO: 2650 - protein, 128 aa, Unknown; identical to SEQ ID NO: 2547
  Description of Unknown: uncultivated organism with predicted taxonomy: Libanicoccus massiliensis
  MG14-156 RuvC-III domain

SEQ ID NO: 2651 - protein, 137 aa, Unknown; identical to SEQ ID NO: 2540
  Description of Unknown: uncultivated organism with predicted taxonomy: Collinsella
  MG14-157 RuvC-III domain

SEQ ID NO: 2652 - protein, 137 aa, Unknown; identical to SEQ ID NO: 2509
  Description of Unknown: uncultivated organism with predicted taxonomy: Collinsella
  MG14-158 RuvC-III domain

SEQ ID NO: 2653 - protein, 137 aa, Unknown; identical to SEQ ID NO: 2533
  Description of Unknown: uncultivated organism with predicted taxonomy: Collinsella
  MG14-159 RuvC-III domain

SEQ ID NO: 2654 - protein, 137 aa, Unknown; identical to SEQ ID NO: 2553
  Description of Unknown: uncultivated organism with predicted taxonomy: Collinsella
  MG14-160 RuvC-III domain

SEQ ID NO: 2655 - protein, 137 aa, Unknown; identical to SEQ ID NO: 2553
  Description of Unknown: uncultivated organism with predicted taxonomy: Collinsella
  MG14-161 RuvC-III domain

SEQ ID NO: 2656 - protein, 128 aa, Unknown; identical to SEQ ID NO: 2522
  Description of Unknown: uncultivated organism with predicted taxonomy: Olsenella
  MG14-162 RuvC-III domain

SEQ ID NO: 2657 - protein, 137 aa, Unknown; identical to SEQ ID NO: 2553
  Description of Unknown: uncultivated organism with predicted taxonomy: Collinsella
  MG14-163 RuvC-III domain

SEQ ID NO: 2658 - protein, 128 aa, Unknown; identical to SEQ ID NO: 2505
  Description of Unknown: uncultivated organism with predicted taxonomy: Olsenella
  MG14-164 RuvC-III domain

SEQ ID NO: 2659 - protein, 137 aa, Unknown; identical to SEQ ID NO: 2509
  Description of Unknown: uncultivated organism with predicted taxonomy: Collinsella
  MG14-165 RuvC-III domain

SEQ ID NO: 2660 - protein, 137 aa, Unknown; identical to SEQ ID NO: 2533
  Description of Unknown: uncultivated organism with predicted taxonomy: Collinsella sp. AM17-1
  MG14-166 RuvC-III domain

SEQ ID NO: 2661 - protein, 137 aa, Unknown; identical to SEQ ID NO: 2538
  Description of Unknown: uncultivated organism with predicted taxonomy: Collinsella
  MG14-167 RuvC-III domain

SEQ ID NO: 2662 - protein, 128 aa, Unknown; identical to SEQ ID NO: 2505
  Description of Unknown: uncultivated organism with predicted taxonomy: Olsenella sp. KH3B4
  MG14-168 RuvC-III domain

SEQ ID NO: 2663 - protein, 128 aa, Unknown; identical to SEQ ID NO: 2511
  Description of Unknown: uncultivated organism with predicted taxonomy: Olsenella
  MG14-169 RuvC-III domain

SEQ ID NO: 2664 - protein, 128 aa, Unknown; identical to SEQ ID NO: 2529
  Description of Unknown: uncultivated organism with predicted taxonomy: Olsenella sp. KH3B4
  MG14-170 RuvC-III domain

SEQ ID NO: 2665 - protein, 123 aa, Unknown; identical to SEQ ID NO: 2528
  Description of Unknown: uncultivated organism with predicted taxonomy: Coriobacteriia bacterium
  MG14-171 RuvC-III domain

SEQ ID NO: 2666 - protein, 137 aa, Unknown; identical to SEQ ID NO: 2561
  Description of Unknown: uncultivated organism with predicted taxonomy: Collinsella
  MG14-172 RuvC-III domain

SEQ ID NO: 2667 - protein, 137 aa, Unknown; identical to SEQ ID NO: 2533
  Description of Unknown: uncultivated organism with predicted taxonomy: Collinsella
  MG14-173 RuvC-III domain

SEQ ID NO: 2668 - protein, 137 aa, Unknown
  Description of Unknown: uncultivated organism with predicted taxonomy: Collinsella
  MG14-174 RuvC-III domain
TDTAYMSREVCAYLADCLLFPDDGAKAHVVPTTGRATAWLRRRWGLNFGSNGEKDRSDDRHHATDACVIAACSRSLVIKTARINQETHWSIIRGMNETQRRDAIMKALESVMPWETFANEVRVAHDFVVPTRFVPRK

SEQ ID NO: 2669 - protein, 137 aa, Unknown; identical to SEQ ID NO: 2535
  Description of Unknown: uncultivated organism with predicted taxonomy: Collinsella
  MG14-175 RuvC-III domain

SEQ ID NO: 2670 - protein, 137 aa, Unknown; identical to SEQ ID NO: 2535
  Description of Unknown: uncultivated organism with predicted taxonomy: Collinsella aerofaciens
  MG14-176 RuvC-III domain

SEQ ID NO: 2671 - protein, 137 aa, Unknown; identical to SEQ ID NO: 2533
  Description of Unknown: uncultivated organism with predicted taxonomy: Collinsella
  MG14-177 RuvC-III domain

SEQ ID NO: 2672 - protein, 128 aa, Unknown
  Description of Unknown: uncultivated organism with predicted taxonomy: Olsenella sp. GAM18
  MG14-178 RuvC-III domain
NDDRYMSVAVKNYLEDCLLFPEDGRKRHVTAVAGGATGNLRWVWGLNFGEGNIKDRTDDRHHAVDAAIIAACSESTVKKVAEASAKGREAFKQLRKSRLADTQPWPTFATEVAARREFVVPTRMADHG

SEQ ID NO: 2673 - protein, 137 aa, Unknown; identical to SEQ ID NO: 2533
  Description of Unknown: uncultivated organism with predicted taxonomy: Collinsella
  MG14-179 RuvC-III domain

SEQ ID NO: 2674 - protein, 137 aa, Unknown; identical to SEQ ID NO: 2545
  Description of Unknown: uncultivated organism with predicted taxonomy: Collinsella
  MG14-180 RuvC-III domain

SEQ ID NO: 2675 - protein, 128 aa, Unknown; identical to SEQ ID NO: 2566
  Description of Unknown: uncultivated organism with predicted taxonomy: Olsenella
  MG14-181 RuvC-III domain

SEQ ID NO: 2676 - protein, 137 aa, Unknown; identical to SEQ ID NO: 2533
  Description of Unknown: uncultivated organism with predicted taxonomy: Olsenella mediterranea
  MG14-182 RuvC-III domain

SEQ ID NO: 2677 - protein, 137 aa, Unknown; identical to SEQ ID NO: 2609
  Description of Unknown: uncultivated organism with predicted taxonomy: Collinsella
  MG14-183 RuvC-III domain

SEQ ID NO: 2678 - protein, 128 aa, Unknown; identical to SEQ ID NO: 2617
  Description of Unknown: uncultivated organism with predicted taxonomy: Olsenella
  MG14-184 RuvC-III domain

SEQ ID NO: 2679 - protein, 137 aa, Unknown; identical to SEQ ID NO: 2533
  Description of Unknown: uncultivated organism with predicted taxonomy: Collinsella
  MG14-185 RuvC-III domain

SEQ ID NO: 2680 - protein, 137 aa, Unknown; identical to SEQ ID NO: 2591
  Description of Unknown: uncultivated organism with predicted taxonomy: Collinsella
  MG14-186 RuvC-III domain

SEQ ID NO: 2681 - protein, 137 aa, Unknown; identical to SEQ ID NO: 2585
  Description of Unknown: uncultivated organism with predicted taxonomy: Coriobacteriales
  MG14-187 RuvC-III domain

SEQ ID NO: 2682 - protein, 137 aa, Unknown; identical to SEQ ID NO: 2533
  Description of Unknown: uncultivated organism with predicted taxonomy: Collinsella
  MG14-188 RuvC-III domain

SEQ ID NO: 2683 - protein, 137 aa, Unknown; identical to SEQ ID NO: 2538
  Description of Unknown: uncultivated organism with predicted taxonomy: Collinsella
  MG14-189 RuvC-III domain

SEQ ID NO: 2684 - protein, 137 aa, Unknown; identical to SEQ ID NO: 2533
  Description of Unknown: uncultivated organism with predicted taxonomy: Collinsella
  MG14-190 RuvC-III domain

SEQ ID NO: 2685 - protein, 137 aa, Unknown; identical to SEQ ID NO: 2538
  Description of Unknown: uncultivated organism with predicted taxonomy: Collinsella
  MG14-191 RuvC-III domain

SEQ ID NO: 2686 - protein, 137 aa, Unknown; identical to SEQ ID NO: 2540
  Description of Unknown: uncultivated organism with predicted taxonomy: Collinsella
  MG14-192 RuvC-III domain

SEQ ID NO: 2687 - protein, 137 aa, Unknown; identical to SEQ ID NO: 2538
  Description of Unknown: uncultivated organism with predicted taxonomy: Collinsella
  MG14-193 RuvC-III domain

SEQ ID NO: 2688 - protein, 128 aa, Unknown; identical to SEQ ID NO: 2550
  Description of Unknown: uncultivated organism with predicted taxonomy: Olsenella
  MG14-194 RuvC-III domain

SEQ ID NO: 2689 - protein, 137 aa, Unknown; identical to SEQ ID NO: 2535
  Description of Unknown: uncultivated organism with predicted taxonomy: Collinsella
  MG14-195 RuvC-III domain

SEQ ID NO: 2690 - protein, 126 aa, Unknown; identical to SEQ ID NO: 2560
  Description of Unknown: uncultivated organism with predicted taxonomy: Collinsella
  MG14-196 RuvC-III domain

SEQ ID NO: 2691 - protein, 137 aa, Unknown; identical to SEQ ID NO: 2533
  Description of Unknown: uncultivated organism with predicted taxonomy: Collinsella
  MG14-197 RuvC-III domain

SEQ ID NO: 2692 - protein, 137 aa, Unknown; identical to SEQ ID NO: 2545
  Description of Unknown: uncultivated organism with predicted taxonomy: Collinsella
  MG14-198 RuvC-III domain

SEQ ID NO: 2693 - protein, 137 aa, Unknown; identical to SEQ ID NO: 2568
  Description of Unknown: uncultivated organism with predicted taxonomy: Collinsella
  MG14-199 RuvC-III domain

SEQ ID NO: 2694 - protein, 137 aa, Unknown; identical to SEQ ID NO: 2538
  Description of Unknown: uncultivated organism with predicted taxonomy: Collinsella
  MG14-200 RuvC-III domain

SEQ ID NO: 2695 - protein, 137 aa, Unknown; identical to SEQ ID NO: 2533
  Description of Unknown: uncultivated organism with predicted taxonomy: Collinsella
  MG14-201 RuvC-III domain

SEQ ID NO: 2696 - protein, 137 aa, Unknown; identical to SEQ ID NO: 2533
  Description of Unknown: uncultivated organism with predicted taxonomy: Collinsella
  MG14-202 RuvC-III domain

SEQ ID NO: 2697 - protein, 137 aa, Unknown; identical to SEQ ID NO: 2533
  Description of Unknown: uncultivated organism with predicted taxonomy: Collinsella
  MG14-203 RuvC-III domain

SEQ ID NO: 2698 - protein, 137 aa, Unknown; identical to SEQ ID NO: 2538
  Description of Unknown: uncultivated organism with predicted taxonomy: Collinsella
  MG14-204 RuvC-III domain

SEQ ID NO: 2699 - protein, 137 aa, Unknown; identical to SEQ ID NO: 2533
  Description of Unknown: uncultivated organism with predicted taxonomy: Olsenella mediterranea
  MG14-205 RuvC-III domain

SEQ ID NO: 2700 - protein, 73 aa, Unknown
  Description of Unknown: uncultivated organism with predicted taxonomy: Collinsella
  MG14-206 RuvC-III domain
TDTAYMSREVCAYLADCLLFPDDGAKAHVVPTTGRATAWLRRRWGLNFGSNGEKDRSDDRHHACHRCLCDCSM

SEQ ID NO: 2701 - protein, 137 aa, Unknown; identical to SEQ ID NO: 2630
  Description of Unknown: uncultivated organism with predicted taxonomy: Collinsella
  MG14-207 RuvC-III domain

SEQ ID NO: 2702 - protein, 128 aa, Unknown; identical to SEQ ID NO: 2597
  Description of Unknown: uncultivated organism with predicted taxonomy: Olsenella
  MG14-208 RuvC-III domain

SEQ ID NO: 2703 - protein, 137 aa, Unknown; identical to SEQ ID NO: 2559
  Description of Unknown: uncultivated organism with predicted taxonomy: Collinsella
  MG14-209 RuvC-III domain

SEQ ID NO: 2704 - protein, 137 aa, Unknown; identical to SEQ ID NO: 2575
  Description of Unknown: uncultivated organism with predicted taxonomy: Collinsella
  MG14-210 RuvC-III domain

SEQ ID NO: 2705 - protein, 137 aa, Unknown; identical to SEQ ID NO: 2533
  Description of Unknown: uncultivated organism with predicted taxonomy: Collinsella
  MG14-211 RuvC-III domain

SEQ ID NO: 2706 - protein, 126 aa, Unknown; identical to SEQ ID NO: 2590
  Description of Unknown: uncultivated organism with predicted taxonomy: Collinsella
  MG14-212 RuvC-III domain

SEQ ID NO: 2707 - protein, 137 aa, Unknown; identical to SEQ ID NO: 2533
  Description of Unknown: uncultivated organism with predicted taxonomy: Collinsella
  MG14-213 RuvC-III domain

SEQ ID NO: 2708 - protein, 137 aa, Unknown; identical to SEQ ID NO: 2533
  Description of Unknown: uncultivated organism with predicted taxonomy: Coriobacteriales
  MG14-214 RuvC-III domain

SEQ ID NO: 2709 - protein, 115 aa, Unknown
  Description of Unknown: uncultivated organism with predicted taxonomy: Olsenella
  MG14-215 RuvC-III domain
NDTRYMSRATMAFLADTLEYPDDGRKRHVIAVAGSATSALRHVWGLNFGEGNVKDRSDDRHHAVDACVIAACSESTLKKVARARSRGYRSFKKTQESRLSDTQPWPTFADDVIAM

SEQ ID NO: 2710 - protein, 137 aa, Unknown; identical to SEQ ID NO: 2533
  Description of Unknown: uncultivated organism with predicted taxonomy: Collinsella
  MG14-216 RuvC-III domain

SEQ ID NO: 2711 - protein, 137 aa, Unknown; identical to SEQ ID NO: 2533
  Description of Unknown: uncultivated organism with predicted taxonomy: Collinsella
  MG14-217 RuvC-III domain

SEQ ID NO: 2712 - protein, 137 aa, Unknown
  Description of Unknown: uncultivated organism with predicted taxonomy: Olsenella mediterranea
  MG14-218 RuvC-III domain
TDTAYMSREVCAYLADCLLFPDDGAKAHVVPTTGRATAWLRRRWGLSFGSNGEKDRSDDRHHATDACVIAACSRSLVIKTARINQETHWSITRGMNETQRRDAIMKALESVMPWETFANEVRAAHDFVVPTRFVPRK

SEQ ID NO: 2713 - protein, 137 aa, Unknown; identical to SEQ ID NO: 2538
  Description of Unknown: uncultivated organism with predicted taxonomy: Collinsella
  MG14-219 RuvC-III domain

SEQ ID NO: 2714 - protein, 137 aa, Unknown; identical to SEQ ID NO: 2538
  Description of Unknown: uncultivated organism with predicted taxonomy: Collinsella
  MG14-220 RuvC-III domain

SEQ ID NO: 2715 - protein, 137 aa, Unknown; identical to SEQ ID NO: 2540
  Description of Unknown: uncultivated organism with predicted taxonomy: Collinsella
  MG14-221 RuvC-III domain

SEQ ID NO: 2716 - protein, 137 aa, Unknown; identical to SEQ ID NO: 2538
  Description of Unknown: uncultivated organism with predicted taxonomy: Collinsella
  MG14-222 RuvC-III domain

SEQ ID NO: 2717 - protein, 126 aa, Unknown
  Description of Unknown: uncultivated organism with predicted taxonomy: Collinsella sp. AM13-34
  MG14-223 RuvC-III domain
NDTRYMSVALAKWLRECLPFTKDGHEHVFCVAGGATALMRSVWDIGITGPDGKKNRDDDRHHAVDAAVIACCTPGIVRNVALVNEGHARADVRQRLFSDSLPYPEFKEQVDAWIPCIVPTLTLPNT

SEQ ID NO: 2718 - protein, 137 aa, Unknown; identical to SEQ ID NO: 2563
  Description of Unknown: uncultivated organism with predicted taxonomy: Collinsella
  MG14-224 RuvC-III domain

SEQ ID NO: 2719 - protein, 137 aa, Unknown; identical to SEQ ID NO: 2499
  Description of Unknown: uncultivated organism with predicted taxonomy: Collinsella
  MG14-225 RuvC-III domain

SEQ ID NO: 2720 - protein, 137 aa, Unknown; identical to SEQ ID NO: 2499
  Description of Unknown: uncultivated organism with predicted taxonomy: Collinsella
  MG14-226 RuvC-III domain

SEQ ID NO: 2721 - protein, 137 aa, Unknown; identical to SEQ ID NO: 2533
  Description of Unknown: uncultivated organism with predicted taxonomy: Collinsella
  MG14-227 RuvC-III domain

SEQ ID NO: 2722 - protein, 137 aa, Unknown; identical to SEQ ID NO: 2567
  Description of Unknown: uncultivated organism with predicted taxonomy: Olsenella
  MG14-228 RuvC-III domain

SEQ ID NO: 2723 - protein, 137 aa, Unknown; identical to SEQ ID NO: 2614
  Description of Unknown: uncultivated organism with predicted taxonomy: Olsenella
  MG14-229 RuvC-III domain

SEQ ID NO: 2724 - protein, 137 aa, Unknown; identical to SEQ ID NO: 2533
  Description of Unknown: uncultivated organism with predicted taxonomy: Collinsella
  MG14-230 RuvC-III domain

SEQ ID NO: 2725 - protein, 137 aa, Unknown; identical to SEQ ID NO: 2607
  Description of Unknown: uncultivated organism with predicted taxonomy: Collinsella
  MG14-231 RuvC-III domain

SEQ ID NO: 2726 - protein, 137 aa, Unknown; identical to SEQ ID NO: 2538
  Description of Unknown: uncultivated organism with predicted taxonomy: Collinsella
  MG14-232 RuvC-III domain

SEQ ID NO: 2727 - protein, 137 aa, Unknown; identical to SEQ ID NO: 2533
  Description of Unknown: uncultivated organism with predicted taxonomy: Collinsella
  MG14-233 RuvC-III domain

SEQ ID NO: 2728 - protein, 137 aa, Unknown; identical to SEQ ID NO: 2541
  Description of Unknown: uncultivated organism with predicted taxonomy: Collinsella
  MG14-234 RuvC-III domain

SEQ ID NO: 2729 - protein, 137 aa, Unknown; identical to SEQ ID NO: 2611
  Description of Unknown: uncultivated organism with predicted taxonomy: Collinsella
  MG14-235 RuvC-III domain

SEQ ID NO: 2730 - protein, 137 aa, Unknown; identical to SEQ ID NO: 2533
  Description of Unknown: uncultivated organism with predicted taxonomy: Collinsella
  MG14-236 RuvC-III domain

SEQ ID NO: 2731 - protein, 137 aa, Unknown; identical to SEQ ID NO: 2533
  Description of Unknown: uncultivated organism with predicted taxonomy: Collinsella
  MG14-237 RuvC-III domain

SEQ ID NO: 2732 - protein, 123 aa, Unknown; identical to SEQ ID NO: 2603
  Description of Unknown: uncultivated organism with predicted taxonomy: Atopobium sp. ICM42b
  MG14-238 RuvC-III domain

SEQ ID NO: 2733 - protein, 137 aa, Unknown; identical to SEQ ID NO: 2578
  Description of Unknown: uncultivated organism with predicted taxonomy: Collinsella
  MG14-239 RuvC-III domain

SEQ ID NO: 2734 - protein, 137 aa, Unknown; identical to SEQ ID NO: 2593
  Description of Unknown: uncultivated organism with predicted taxonomy: Collinsella
  MG14-240 RuvC-III domain

SEQ ID NO: 2735 - protein, 137 aa, Unknown; identical to SEQ ID NO: 2616
  Description of Unknown: uncultivated organism with predicted taxonomy: Collinsella
  MG14-241 RuvC-III domain

SEQ ID NO: 2736 - protein, 137 aa, Unknown; identical to SEQ ID NO: 2499
  Description of Unknown: uncultivated organism with predicted taxonomy: Collinsella
  MG14-242 RuvC-III domain

SEQ ID NO: 2737 - protein, 137 aa, Unknown; identical to SEQ ID NO: 2541
  Description of Unknown: uncultivated organism with predicted taxonomy: Collinsella
  MG14-243 RuvC-III domain

SEQ ID NO: 2738 - protein, 129 aa, Unknown
  Description of Unknown: uncultivated organism
  MG14-244 RuvC-III domain
NDTRYMSVAVKNYLEDCLLFPEDGRKLHVTAVSGGATASLRRVWGLNSNGSDDEKTNSNTMRNSIDAAVIAACSVKTVQAVAKTRSLGRETFRHMRRSRLADTQPWETFADDVIVKCKTVIPTRMAEHG

SEQ ID NO: 2739 - protein, 128 aa, Unknown
  Description of Unknown: uncultivated organism with predicted taxonomy: Olsenella
  MG14-245 RuvC-III domain
NDDRYMSVAVKNYLEDCLLFPNDGRKKHVTAVAGGATGNLRWVWGLNFGQGNTKDRDDDRHHAVDAAIIAACSESTVKKVAEASSKGRETFKHLRKSRLSDTQPWPTFAEEVAARRAFVVPTRMVNHG

SEQ ID NO: 2740 - protein, 128 aa, Unknown
  Description of Unknown: uncultivated organism with predicted taxonomy: Coriobacteriales
  MG14-246 RuvC-III domain
NDTRYMSVAVKDYLEKSLLFPDDGRKSHVIAVAGGATSALRHVWGLNFGADNTKDRSDDRHHAVDAAVIAACSQATVKKVADTSKLGHSEFKRKRESRLADTQPWPTFADEVIARREFVIPTRMANHG

SEQ ID NO: 2741 - protein, 128 aa, Unknown; identical to SEQ ID NO: 2740
  Description of Unknown: uncultivated organism with predicted taxonomy: Coriobacteriales
  MG14-247 RuvC-III domain

SEQ ID NO: 2742 - protein, 128 aa, Unknown; identical to SEQ ID NO: 2740
  Description of Unknown: uncultivated organism
  MG14-248 RuvC-III domain

SEQ ID NO: 2743 - protein, 128 aa, Unknown; identical to SEQ ID NO: 2740
  Description of Unknown: uncultivated organism with predicted taxonomy: Olsenella
  MG14-249 RuvC-III domain

SEQ ID NO: 2744 - protein, 128 aa, Unknown
  Description of Unknown: uncultivated organism with predicted taxonomy: Olsenella
  MG14-250 RuvC-III domain
NDTRYMSVAVKNYLEDCLQFPDDGRKTHVIAVAGGATASLRHVWGLNFGKNNEKDRTDNRHHAVDAAVIAACSTKTVQAVARASSVGRESFKHIRQSRLADTQPWKTFAEDVITERSFVIPTYMADHG

SEQ ID NO: 2745 - protein, 129 aa, Unknown
  Description of Unknown: uncultivated organism
  MG14-251 RuvC-III domain
NDTRYMSVAIKNYLEDCLLFPEDGRKLHVTAVSGGATASLRRVWGLNTKGSDDEKTNSDTMRNAIDAAVIAACSVKTVQAVAKTRSLGRETFRHMRRSRLADTQPWETFADDVLAKCETVIPTRMAEHG

SEQ ID NO: 2746 - protein, 128 aa, Unknown
  Description of Unknown: uncultivated organism with predicted taxonomy: Olsenella umbonata
  MG14-252 RuvC-III domain
NDDRYMSRAVKSYLEDTLIFPEDGRKKHVTAVSGGATGSLRHVWGLNFGDGNTKDRSDNRHHAVDACVIAACSEATVQAVAKARKLGAEAYKHIREDRLKDTQPWPTFADEVVARREFVIPTRMVSHG

SEQ ID NO: 2747 - protein, 123 aa, Unknown
  Description of Unknown: uncultivated organism with predicted taxonomy: Atopobium sp. ICM42b
  MG14-253 RuvC-III domain
NDNRYLSRAVMNWLAETLAFGDMDRRHVYAVTGAGTAILRKSWALNFGPNGLKDRNYDRHHAIDAAVIAACSVSTIQAIATAHAHERRLSESRMVSTQPWPSFAIELTQRIERVVPTHQVQHK

SEQ ID NO: 2748 - protein, 128 aa, Unknown; identical to SEQ ID NO: 2744
  Description of Unknown: uncultivated organism with predicted taxonomy: Olsenella sp. KH3B4
  MG14-254 RuvC-III domain

SEQ ID NO: 2749 - protein, 128 aa, Unknown; identical to SEQ ID NO: 2746
  Description of Unknown: uncultivated organism with predicted taxonomy: Olsenella
  MG14-255 RuvC-III domain

SEQ ID NO: 2750 - protein, 93 aa, Unknown
  Description of Unknown: uncultivated organism with predicted taxonomy: Olsenella
  MG14-256 RuvC-III domain
NDNRYLSRSVMNWLADTLAFDNLGHRHVYAVTGAGTAILRRHWALNFGSNGLKDRNDDRHHAIDAAVIAACSVSTIQSIATAHARGYRSSESR

SEQ ID NO: 2751 - protein, 153 aa, Unknown
  Description of Unknown: uncultivated organism with predicted taxonomy: Megasphaera
  MG15-1 RuvC-III domain
QDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRK

SEQ ID NO: 2752 - protein, 169 aa, Unknown
  Description of Unknown: uncultivated organism with predicted taxonomy: Selenomonas sp. AE3005
  MG15-3 RuvC-III domain
TDTQYISRFVKNLLDEHLEFAPWLSGKKQHVIAVNGAVTDYTRKRLGIRKIREDGDLHHAVDAAVIATVTQGNIQKLTNYSKRIECACIKNSDGSYTNPDTGEILKKDELIVQMSKHFPEPWPKFRHELEARVSDHPKELIESLKLPSYSMEEIDALKPPFVSRMPTRK

SEQ ID NO: 2753 - protein, 169 aa, Unknown; identical to SEQ ID NO: 2752
  Description of Unknown: uncultivated organism with predicted taxonomy: Selenomonas sp. AE3005
  MG15-4 RuvC-III domain

SEQ ID NO: 2754 - protein, 158 aa, Unknown
  Description of Unknown: uncultivated organism with predicted taxonomy: Veillonellales
  MG15-6 RuvC-III domain
QDTQYISRFLYNYLRNTLKLAPGYTDRKRRIIPVNGAVTGYIRKRLDIRKIRENGDLHHAVDAVVIAVTTQGMIQKVTRYSQIRENPKLIDKKTGEVLTAKEFHNKDNFPEPWPRFRQELEVRVSEDPEEAIRRLRLPAYENVGEIKKPFVSRMPRRK

SEQ ID NO: 2755 - protein, 153 aa, Unknown
  Description of Unknown: uncultivated organism with predicted taxonomy: Megasphaera stantonii
  MG15-7 RuvC-III domain
QDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRK

SEQ ID NO: 2756 - protein, 164 aa, Unknown
  Description of Unknown: uncultivated organism with predicted taxonomy: Dialister
  MG15-8 RuvC-III domain
QDTQYISRFLYNYLRNTLELAPGYTDRKRRIIPVNGAVTGYIRKRLDIRKIRENGDLHHAVDAVVIAATTQGMIQKVTRYSQIKENETWIDDHTKVDERTGEIFFVKKAHEKDAFPEPWPRFRQELEARVSEDPEEAIRRLGLPSYENAGEIKKPFVSRMPRRK

SEQ ID NO: 2757 - protein, 153 aa, Unknown; identical to SEQ ID NO: 2755
  Description of Unknown: uncultivated organism with predicted taxonomy: Dialister invisus
  MG15-9 RuvC-III domain

SEQ ID NO: 2758 - protein, 153 aa, Unknown
  Description of Unknown: uncultivated organism with predicted taxonomy: Dialister
  MG15-10 RuvC-III domain
QDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRK

SEQ ID NO: 2759 - protein, 153 aa, Unknown; identical to SEQ ID NO: 2758
  Description of Unknown: uncultivated organism with predicted taxonomy: Dialister
  MG15-11 RuvC-III domain

SEQ ID NO: 2760 - protein, 167 aa, Unknown
  Description of Unknown: uncultivated organism with predicted taxonomy: Megasphaera micronuciformis
  MG15-12 RuvC-III domain
QDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENATEAIRILNLPTYSPDEEIKTPFVSRMVRHK

SEQ ID NO: 2761 - protein, 153 aa, Unknown; identical to SEQ ID NO: 2755
  Description of Unknown: uncultivated organism with predicted taxonomy: Megasphaera sp. AM44-1BH
  MG15-13 RuvC-III domain

SEQ ID NO: 2762 - protein, 153 aa, Unknown
  Description of Unknown: uncultivated organism with predicted taxonomy: Dialister
  MG15-14 RuvC-III domain
QDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRK

SEQ ID NO: 2763 - protein, 167 aa, Unknown
  Description of Unknown: uncultivated organism with predicted taxonomy: Megasphaera micronuciformis
  MG15-15 RuvC-III domain
QDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWPQFRAELEARVSENAAEAIRILNLPTYSPDEEIKTPFVSRMVRHK

SEQ ID NO: 2764 - protein, 165 aa, Unknown
  Description of Unknown: uncultivated organism with predicted taxonomy: Megasphaera stantonii
  MG15-16 RuvC-III domain
QDTQYISRYLYNYLKRHIELKEGYTDRKRRIIPVNGAVTAYVRKRLGISKIRENGDLHHAVDAVIIACVTQGVVNKISRYSKIKELRQFMTADGTIVDQETGEVLQTANPRKTDPFPEPWPKFRQELEARVSDNPAEAIAALRLPTYEGIVTISAPFVSRMPNRK

SEQ ID NO: 2765 - protein, 153 aa, Unknown; identical to SEQ ID NO: 2755
  Description of Unknown: uncultivated organism with predicted taxonomy: Dialister
  MG15-17 RuvC-III domain

SEQ ID NO: 2766 - protein, 167 aa, Unknown
  Description of Unknown: uncultivated organism with predicted taxonomy: Megasphaera micronuciformis
  MG15-18 RuvC-III domain
QDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHK

SEQ ID NO: 2767 - protein, 167 aa, Unknown
  Description of Unknown: uncultivated organism with predicted taxonomy: Megasphaera micronuciformis
  MG15-19 RuvC-III domain
QDTQYISRFMLNYLQNNYELTPGNTDRRRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHK

SEQ ID NO: 2768 - protein, 153 aa, Unknown; identical to SEQ ID NO: 2751
  Description of Unknown: uncultivated organism with predicted taxonomy: Dialister
  MG15-20 RuvC-III domain

SEQ ID NO: 2769 - protein, 153 aa, Unknown; identical to SEQ ID NO: 2755
  Description of Unknown: uncultivated organism with predicted taxonomy: Dialister
  MG15-21 RuvC-III domain

SEQ ID NO: 2770 - protein, 153 aa, Unknown; identical to SEQ ID NO: 2751
  Description of Unknown: uncultivated organism with predicted taxonomy: Dialister
  MG15-22 RuvC-III domain

SEQ ID NO: 2771 - protein, 153 aa, Unknown; identical to SEQ ID NO: 2758
  Description of Unknown: uncultivated organism with predicted taxonomy: Dialister
  MG15-23 RuvC-III domain

SEQ ID NO: 2772 - protein, 153 aa, Unknown
  Description of Unknown: uncultivated organism with predicted taxonomy: Dialister invisus
  MG15-24 RuvC-III domain
QDTQYISKYLYNYLLENLELAKGYTERKRRIIPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFVSHMPNRK

SEQ ID NO: 2773 - protein, 153 aa, Unknown; identical to SEQ ID NO: 2772
  Description of Unknown: uncultivated organism with predicted taxonomy: Dialister
  MG15-25 RuvC-III domain

SEQ ID NO: 2774 - protein, 153 aa, Unknown; identical to SEQ ID NO: 2751
  Description of Unknown: uncultivated organism with predicted taxonomy: Dialister
  MG15-26 RuvC-III domain

SEQ ID NO: 2775 - protein, 153 aa, Unknown
  Description of Unknown: uncultivated organism with predicted taxonomy: Dialister
  MG15-27 RuvC-III domain
QDTQYISKYLYNYLRHHLVLAKGYTERKRRIIPVNGAVTAYFRKRLGINKIRGNGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRK

SEQ ID NO: 2776 - protein, 153 aa, Unknown; identical to SEQ ID NO: 2751
  Description of Unknown: uncultivated organism with predicted taxonomy: Dialister
  MG15-28 RuvC-III domain

SEQ ID NO: 2777 - protein, 119 aa, Unknown
  Description of Unknown: uncultivated organism with predicted taxonomy: Dialister invisus
  MG15-29 RuvC-III domain
QDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRY

SEQ ID NO: 2778 - protein, 153 aa, Unknown; identical to SEQ ID NO: 2755
  Description of Unknown: uncultivated organism with predicted taxonomy: Megasphaera sp. AM44-1BH
  MG15-30 RuvC-III domain

SEQ ID NO: 2779 - protein, 153 aa, Unknown
  Description of Unknown: uncultivated organism with predicted taxonomy: Dialister
  MG15-31 RuvC-III domain
QDTQYISKYLYNYLRHHLVLAKGYTERKRRIIPVNGAVTAYFRKRLGINKIRENGDLHHAVDAVIIACATQGIINKVSRYSKSRELWDYEVDMETGEVLQKKNKNTKDVFPEPWLNFRYELEQKVRVRPLNIPETADITEMEEPFVSHMPNRK

SEQ ID NO: 2780 - protein, 153 aa, Unknown; identical to SEQ ID NO: 2751
  Description of Unknown: uncultivated organism with predicted taxonomy: Veillonellales
  MG15-32 RuvC-III domain

SEQ ID NO: 2781 - protein, 153 aa, Unknown
  Description of Unknown: uncultivated organism with predicted taxonomy: Dialister
  MG15-33 RuvC-III domain
QDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRK

SEQ ID NO: 2782 - protein, 153 aa, Unknown; identical to SEQ ID NO: 2772
  Description of Unknown: uncultivated organism with predicted taxonomy: Megasphaera
  MG15-34 RuvC-III domain

SEQ ID NO: 2783 - protein, 165 aa, Unknown; identical to SEQ ID NO: 2764
  Description of Unknown: uncultivated organism with predicted taxonomy: Megasphaera
  MG15-35 RuvC-III domain

SEQ ID NO: 2784 - protein, 153 aa, Unknown; identical to SEQ ID NO: 2772
  Description of Unknown: uncultivated organism with predicted taxonomy: Dialister
  MG15-36 RuvC-III domain

SEQ ID NO: 2785 - protein, 153 aa, Unknown; identical to SEQ ID NO: 2772
  Description of Unknown: uncultivated organism with predicted taxonomy: Dialister
  MG15-37 RuvC-III domain

SEQ ID NO: 2786 - protein, 170 aa, Unknown
  Description of Unknown: uncultivated organism with predicted taxonomy: Selenomonas bovis
  MG15-38 RuvC-III domain
NDTKYISRFIYNLIRQHLQFAPFRTDRKQHIISVNGAVTSYIRKRLGIPKIREDGDLHHAVDAVVIASITQGTIQKVTRYSREKETLYHCDSKGRLIDTSTGEILSPEEHQRRLAEKFPEPWPCFRKEIEARISHHPAENLRLLHLPTYTEEELAELEKPIFVSRMPNHK

SEQ ID NO: 2787 - protein, 153 aa, Unknown; identical to SEQ ID NO: 2751
  Description of Unknown: uncultivated organism with predicted taxonomy: Dialister
  MG15-39 RuvC-III domain

SEQ ID NO: 2788 - protein, 153 aa, Unknown; identical to SEQ ID NO: 2751
  Description of Unknown: uncultivated organism with predicted taxonomy: Dialister
  MG15-40 RuvC-III domain

SEQ ID NO: 2789 - protein, 165 aa, Unknown
  Description of Unknown: uncultivated organism with predicted taxonomy: Megasphaera sp. AM44-1BH
  MG15-41 RuvC-III domain
QDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEILTLKHVHKKDPFPEPWPHFRQELEARVGKQPQEAIAALHLPTYKNVESIYTPFVSRMPNRK

SEQ ID NO: 2790 - protein, 167 aa, Unknown
  Description of Unknown: uncultivated organism with predicted taxonomy: Veillonellales
  MG15-42 RuvC-III domain
QDTQYISRFLYNYLRQNLPLKEGFTNRKRRIIPVNGAVTSYVRKRLGIAKIRENGDLHHAVDAVIIACVTQGVIKRVSEYSKSRELWLYQLDDGTVIDGETGEVMTGQRGHKQEPFPEPWPEFRHELEDRVSENPPELLRHLQLPAYEGIDIETIKTPFVSRMPNRK

SEQ ID NO: 2791 - protein, 153 aa, Unknown; identical to SEQ ID NO: 2758
  Description of Unknown: uncultivated organism with predicted taxonomy: Veillonellales
  MG15-43 RuvC-III domain

SEQ ID NO: 2792 - protein, 167 aa, Unknown; identical to SEQ ID NO: 2790
  Description of Unknown: uncultivated organism with predicted taxonomy: Veillonellales
  MG15-44 RuvC-III domain

SEQ ID NO: 2793 - protein, 170 aa, Unknown; identical to SEQ ID NO: 2786
  Description of Unknown: uncultivated organism with predicted taxonomy: Selenomonas bovis
  MG15-45 RuvC-III domain

SEQ ID NO: 2794 - protein, 153 aa, Unknown
  Description of Unknown: uncultivated organism with predicted taxonomy: Dialister
  MG15-46 RuvC-III domain
QDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRK

SEQ ID NO: 2795 - protein, 158 aa, Unknown
  Description of Unknown: uncultivated organism with predicted taxonomy: Dialister
  MG15-47 RuvC-III domain
QDTQYISRFLYNYLRNTLELTPGYTDRKRRIIPVNGAVTGYIRKRLGIRKIRENGDLHHAVDAVVIAVTTQGMIQKVTRYSQIRENPKLIDKKTGEVLTAKEFHNKDNFPEPWPRFRQELEARVSEDPEEAIRRLRLPAYENVGEIKKPFISRMPRRK

SEQ ID NO: 2796 - protein, 170 aa, Unknown; identical to SEQ ID NO: 2786
  Description of Unknown: uncultivated organism with predicted taxonomy: Selenomonas bovis
  MG15-48 RuvC-III domain

SEQ ID NO: 2797 - protein, 153 aa, Unknown
  Description of Unknown: uncultivated organism with predicted taxonomy: Dialister
  MG15-49 RuvC-III domain
QDTQYISKYLYNYLLENLELAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRK

SEQ ID NO: 2798 - protein, 153 aa, Unknown; identical to SEQ ID NO: 2751
  Description of Unknown: uncultivated organism with predicted taxonomy: Dialister
  MG15-50 RuvC-III domain

SEQ ID NO: 2799 - protein, 153 aa, Unknown; identical to SEQ ID NO: 2758
  Description of Unknown: uncultivated organism with predicted taxonomy: Dialister
  MG15-51 RuvC-III domain

SEQ ID NO: 2800 - protein, 153 aa, Unknown; identical to SEQ ID NO: 2797
  Description of Unknown: uncultivated organism with predicted taxonomy: Veillonellales
  MG15-52 RuvC-III domain

SEQ ID NO: 2801 - protein, 153 aa, Unknown; identical to SEQ ID NO: 2772
  Description of Unknown: uncultivated organism with predicted taxonomy: Dialister invisus
  MG15-53 RuvC-III domain

SEQ ID NO: 2802 - protein, 153 aa, Unknown; identical to SEQ ID NO: 2781
  Description of Unknown: uncultivated organism with predicted taxonomy: Dialister
  MG15-54 RuvC-III domain

SEQ ID NO: 2803 - protein, 167 aa, Unknown
  Description of Unknown: uncultivated organism with predicted taxonomy: Megasphaera stantonii
  MG15-55 RuvC-III domain
QDTQYISRFMLNYLQNNYELTPGNTNRKRRIIPVNGAVTAYVRKRLGISKIRENGDLHHAVDATVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHK

SEQ ID NO: 2804 - protein, 170 aa, Unknown; identical to SEQ ID NO: 2786
  Description of Unknown: uncultivated organism with predicted taxonomy: Selenomonas bovis
  MG15-56 RuvC-III domain

SEQ ID NO: 2805 - protein, 153 aa, Unknown; identical to SEQ ID NO: 2781
  Description of Unknown: uncultivated organism with predicted taxonomy: Dialister
  MG15-57 RuvC-III domain

SEQ ID NO: 2806 - protein, 153 aa, Unknown; identical to SEQ ID NO: 2794
  Description of Unknown: uncultivated organism with predicted taxonomy: Dialister
  MG15-58 RuvC-III domain

SEQ ID NO: 2807 - protein, 153 aa, Unknown; identical to SEQ ID NO: 2794
  Description of Unknown: uncultivated organism with predicted taxonomy: Dialister
  MG15-59 RuvC-III domain

SEQ ID NO: 2808 - protein, 153 aa, Unknown; identical to SEQ ID NO: 2772
  Description of Unknown: uncultivated organism with predicted taxonomy: Megasphaera
  MG15-60 RuvC-III domain

SEQ ID NO: 2809 - protein, 153 aa, Unknown; identical to SEQ ID NO: 2772
  Description of Unknown: uncultivated organism with predicted taxonomy: Dialister
  MG15-61 RuvC-III domain

SEQ ID NO: 2810 - protein, 167 aa, Unknown; identical to SEQ ID NO: 2766
  Description of Unknown: uncultivated organism with predicted taxonomy: Megasphaera stantonii
  MG15-62 RuvC-III domain

SEQ ID NO: 2811 - protein, 153 aa, Unknown; identical to SEQ ID NO: 2762
  Description of Unknown: uncultivated organism with predicted taxonomy: Dialister
  MG15-63 RuvC-III domain

SEQ ID NO: 2812 - protein, 153 aa, Unknown; identical to SEQ ID NO: 2794
  Description of Unknown: uncultivated organism with predicted taxonomy: Megasphaera
  MG15-64 RuvC-III domain

SEQ ID NO: 2813 - protein, 153 aa, Unknown; identical to SEQ ID NO: 2751
  Description of Unknown: uncultivated organism with predicted taxonomy: Dialister
  MG15-65 RuvC-III domain

SEQ ID NO: 2814 - protein, 167 aa, Unknown; identical to SEQ ID NO: 2766
  Description of Unknown: uncultivated organism with predicted taxonomy: Megasphaera micronuciformis
  MG15-66 RuvC-III domain

SEQ ID NO: 2815 - protein, 167 aa, Unknown; identical to SEQ ID NO: 2766
  Description of Unknown: uncultivated organism with predicted taxonomy: Megasphaera stantonii
  MG15-67 RuvC-III domain

SEQ ID NO: 2816 - protein, 153 aa, Unknown
  Description of Unknown: uncultivated organism with predicted taxonomy: Veillonellaceae bacterium DNF00626
  MG15-68 RuvC-III domain
QDTQYISSYLYRYLMQNITLAPGYTDRKERIISLNGVVTGYVRKRWRIPKIRANGDLHHAVDAVVIACINDRLIKRVTEYSKAKELEYTPSDSGAVKTSMKDGFPEPWYCFRQELKARLSETPDEAIRNLHLATYCNVGNIKTPFVSRMLKCK

SEQ ID NO: 2817 - protein, 164 aa, Unknown
  Description of Unknown: uncultivated organism with predicted taxonomy: Dialister
  MG15-69 RuvC-III domain
QDTQYISRFLYNYLRNTLELTPGYTDRKRRIIPVNGAVTGYIRKRLGIHKIRENGDLHHAVDAVVIAATTQGMIQKVTRYSQIKENETWIDDHTKVDERTGEIFFVKKAHEKDAFPEPWPRFRQELEARVSEDPEETIRRLRLPSYENAGEIKKPFVSRMPRRK

SEQ ID NO: 2818 - protein, 153 aa, Unknown; identical to SEQ ID NO: 2758
  Description of Unknown: uncultivated organism with predicted taxonomy: Dialister
  MG15-70 RuvC-III domain

SEQ ID NO: 2819 - protein, 153 aa, Unknown; identical to SEQ ID NO: 2794
  Description of Unknown: uncultivated organism with predicted taxonomy: Dialister
  MG15-71 RuvC-III domain

SEQ ID NO: 2820 - protein, 153 aa, Unknown; identical to SEQ ID NO: 2758
  Description of Unknown: uncultivated organism with predicted taxonomy: Dialister
  MG15-72 RuvC-III domain

SEQ ID NO: 2821 - protein, 153 aa, Unknown; identical to SEQ ID NO: 2772
  Description of Unknown: uncultivated organism with predicted taxonomy: Dialister invisus
  MG15-73 RuvC-III domain

SEQ ID NO: 2822 - protein, 153 aa, Unknown; identical to SEQ ID NO: 2772
  Description of Unknown: uncultivated organism with predicted taxonomy: Dialister
  MG15-74 RuvC-III domain

SEQ ID NO: 2823 - protein, 153 aa, Unknown; identical to SEQ ID NO: 2772
  Description of Unknown: uncultivated organism with predicted taxonomy: Dialister invisus
  MG15-75 RuvC-III domain

SEQ ID NO: 2824 - protein, 153 aa, Unknown; identical to SEQ ID NO: 2751
  Description of Unknown: uncultivated organism with predicted taxonomy: Dialister
  MG15-76 RuvC-III domain

SEQ ID NO: 2825 - protein, 153 aa, Unknown; identical to SEQ ID NO: 2781
  Description of Unknown: uncultivated organism with predicted taxonomy: Dialister invisus
  MG15-77 RuvC-III domain

SEQ ID NO: 2826 - protein, 153 aa, Unknown; identical to SEQ ID NO: 2772
  Description of Unknown: uncultivated organism with predicted taxonomy: Dialister
  MG15-78 RuvC-III domain

SEQ ID NO: 2827 - protein, 153 aa, Unknown; identical to SEQ ID NO: 2751
  Description of Unknown: uncultivated organism with predicted taxonomy: Megasphaera stantonii
  MG15-79 RuvC-III domain

SEQ ID NO: 2828 - protein, 153 aa, Unknown; identical to SEQ ID NO: 2755
  Description of Unknown: uncultivated organism with predicted taxonomy: Megasphaera sp. AM44-1BH
  MG15-80 RuvC-III domain

SEQ ID NO: 2829 - protein, 153 aa, Unknown; identical to SEQ ID NO: 2751
  Description of Unknown: uncultivated organism with predicted taxonomy: Megasphaera
  MG15-81 RuvC-III domain

SEQ ID NO: 2830 - protein, 153 aa, Unknown; identical to SEQ ID NO: 2755
  Description of Unknown: uncultivated organism with predicted taxonomy: Megasphaera sp. AM44-1BH
  MG15-82 RuvC-III domain

SEQ ID NO: 2831 - protein, 153 aa, Unknown; identical to SEQ ID NO: 2816
  Description of Unknown: uncultivated organism with predicted taxonomy: Veillonellaceae bacterium DNF00626
  MG15-83 RuvC-III domain

SEQ ID NO: 2832 - protein, 153 aa, Unknown; identical to SEQ ID NO: 2755
  Description of Unknown: uncultivated organism with predicted taxonomy: Dialister
  MG15-84 RuvC-III domain

SEQ ID NO: 2833 - protein, 153 aa, Unknown; identical to SEQ ID NO: 2755
  Description of Unknown: uncultivated organism with predicted taxonomy: Dialister
  MG15-85 RuvC-III domain

SEQ ID NO: 2834 - protein, 153 aa, Unknown; identical to SEQ ID NO: 2775
  Description of Unknown: uncultivated organism with predicted taxonomy: Dialister
  MG15-86 RuvC-III domain

SEQ ID NO: 2835 - protein, 153 aa, Unknown; identical to SEQ ID NO: 2779
  Description of Unknown: uncultivated organism with predicted taxonomy: Dialister
  MG15-87 RuvC-III domain

SEQ ID NO: 2836 - protein, 153 aa, Unknown; identical to SEQ ID NO: 2755
  Description of Unknown: uncultivated organism with predicted taxonomy: Megasphaera sp. AM44-1BH
  MG15-88 RuvC-III domain

SEQ ID NO: 2837 - protein, 153 aa, Unknown; identical to SEQ ID NO: 2755
  Description of Unknown: uncultivated organism with predicted taxonomy: Dialister
  MG15-89 RuvC-III domain

SEQ ID NO: 2838 - protein, 153 aa, Unknown; identical to SEQ ID NO: 2762
  Description of Unknown: uncultivated organism with predicted taxonomy: Dialister
  MG15-90 RuvC-III domain

SEQ ID NO: 2839 - protein, 153 aa, Unknown; identical to SEQ ID NO: 2794
  Description of Unknown: uncultivated organism with predicted taxonomy: Dialister
  MG15-91 RuvC-III domain

SEQ ID NO: 2840 - protein, 165 aa, Unknown; identical to SEQ ID NO: 2764
  Description of Unknown: uncultivated organism with predicted taxonomy: Firmicutes
  MG15-92 RuvC-III domain

SEQ ID NO: 2841 - protein, 167 aa, Unknown; identical to SEQ ID NO: 2763
  Description of Unknown: uncultivated organism with predicted taxonomy: Megasphaera micronuciformis
  MG15-93 RuvC-III domain

SEQ ID NO: 2842 - protein, 153 aa, Unknown; identical to SEQ ID NO: 2797
  Description of Unknown: uncultivated organism with predicted taxonomy: Dialister
  MG15-94 RuvC-III domain

SEQ ID NO: 2843 - protein, 153 aa, Unknown; identical to SEQ ID NO: 2772
  Description of Unknown: uncultivated organism with predicted taxonomy: Dialister
  MG15-95 RuvC-III domain

SEQ ID NO: 2844 - protein, 167 aa, Unknown; identical to SEQ ID NO: 2766
  Description of Unknown: uncultivated organism with predicted taxonomy: Megasphaera micronuciformis
  MG15-96 RuvC-III domain

SEQ ID NO: 2845 - protein, 167 aa, Unknown; identical to SEQ ID NO: 2767
  Description of Unknown: uncultivated organism with predicted taxonomy: Megasphaera micronuciformis
  MG15-97 RuvC-III domain

SEQ ID NO: 2846 - protein, 153 aa, Unknown; identical to SEQ ID NO: 2751
  Description of Unknown: uncultivated organism with predicted taxonomy: Dialister
  MG15-98 RuvC-III domain

SEQ ID NO: 2847 - protein, 167 aa, Unknown; identical to SEQ ID NO: 2766
  Description of Unknown: uncultivated organism with predicted taxonomy: Megasphaera micronuciformis
  MG15-99 RuvC-III domain

SEQ ID NO: 2848 - protein, 167 aa, Unknown; identical to SEQ ID NO: 2766
  Description of Unknown: uncultivated organism with predicted taxonomy: Megasphaera stantonii
  MG15-100 RuvC-III domain

SEQ ID NO: 2849 - protein, 153 aa, Unknown; identical to SEQ ID NO: 2772
  Description of Unknown: uncultivated organism with predicted taxonomy: Dialister
  MG15-101 RuvC-III domain

SEQ ID NO: 2850 - protein, 153 aa, Unknown; identical to SEQ ID NO: 2751
  Description of Unknown: uncultivated organism with predicted taxonomy: Megasphaera
  MG15-102 RuvC-III domain

SEQ ID NO: 2851 - protein, 165 aa, Unknown; identical to SEQ ID NO: 2789
  Description of Unknown: uncultivated organism with predicted taxonomy: Megasphaera sp. AM44-1BH
  MG15-103 RuvC-III domain

SEQ ID NO: 2852 - protein, 153 aa, Unknown; identical to SEQ ID NO: 2751
  Description of Unknown: uncultivated organism with predicted taxonomy: Dialister
  MG15-104 RuvC-III domain

SEQ ID NO: 2853 - protein, 167 aa, Unknown; identical to SEQ ID NO: 2767
  Description of Unknown: uncultivated organism with predicted taxonomy: Megasphaera micronuciformis
  MG15-105 RuvC-III domain

SEQ ID NO: 2854 - protein, 153 aa, Unknown; identical to SEQ ID NO: 2751
  Description of Unknown: uncultivated organism with predicted taxonomy: Dialister
  MG15-106 RuvC-III domain

SEQ ID NO: 2855 - protein, 153 aa, Unknown; identical to SEQ ID NO: 2751
  Description of Unknown: uncultivated organism with predicted taxonomy: Dialister
  MG15-107 RuvC-III domain

SEQ ID NO: 2856 - protein, 153 aa, Unknown; identical to SEQ ID NO: 2751
  Description of Unknown: uncultivated organism with predicted taxonomy: Dialister
  MG15-108 RuvC-III domain

SEQ ID NO: 2857 - protein, 167 aa, Unknown; identical to SEQ ID NO: 2766
  Description of Unknown: uncultivated organism with predicted taxonomy: Megasphaera stantonii
  MG15-109 RuvC-III domain

SEQ ID NO: 2858 - protein, 153 aa, Unknown; identical to SEQ ID NO: 2762
  Description of Unknown: uncultivated organism with predicted taxonomy: Dialister
  MG15-110 RuvC-III domain

SEQ ID NO: 2859 - protein, 153 aa, Unknown; identical to SEQ ID NO: 2751
  Description of Unknown: uncultivated organism with predicted taxonomy: Veillonellales
  MG15-111 RuvC-III domain

SEQ ID NO: 2860 - protein, 153 aa, Unknown; identical to SEQ ID NO: 2772
  Description of Unknown: uncultivated organism with predicted taxonomy: Dialister
  MG15-112 RuvC-III domain

SEQ ID NO: 2861 - protein, 153 aa, Unknown; identical to SEQ ID NO: 2751
  Description of Unknown: uncultivated organism with predicted taxonomy: Dialister
  MG15-113 RuvC-III domain

SEQ ID NO: 2862 - protein, 164 aa, Unknown
  Description of Unknown: uncultivated organism with predicted taxonomy: Veillonellales
  MG15-114 RuvC-III domain
QDTQYISRFLYNYLKNTLELTPGYTDRKRRIIPVNGAVTGYIRKRLGIHKIRENGDLHHAVDAVVIAATTQGMIQKVTRYSQIKENETWIDDHTKVDERTGEIFFVKKAHEKDAFPEPWPRFRQELEARVSEDPEEAIRRLGLPSYENVGEIKKPFVSRMPRRK

SEQ ID NO: 2863 - protein, 153 aa, Unknown; identical to SEQ ID NO: 2751
  Description of Unknown: uncultivated organism with predicted taxonomy: Dialister
  MG15-115 RuvC-III domain

SEQ ID NO: 2864 - protein, 153 aa, Unknown; identical to SEQ ID NO: 2755
  Description of Unknown: uncultivated organism with predicted taxonomy: Megasphaera sp. AM44-1BH
  MG15-116 RuvC-III domain

SEQ ID NO: 2865 - protein, 165 aa, Unknown; identical to SEQ ID NO: 2764
  Description of Unknown: uncultivated organism with predicted taxonomy: Megasphaera
  MG15-117 RuvC-III domain

SEQ ID NO: 2866 - protein, 153 aa, Unknown; identical to SEQ ID NO: 2781
  Description of Unknown: uncultivated organism with predicted taxonomy: Dialister
  MG15-118 RuvC-III domain

SEQ ID NO: 2867 - protein, 158 aa, Unknown; identical to SEQ ID NO: 2795
  Description of Unknown: uncultivated organism with predicted taxonomy: Dialister
  MG15-119 RuvC-III domain

SEQ ID NO: 2868 - protein, 167 aa, Unknown
  Description of Unknown: uncultivated organism with predicted taxonomy: Megasphaera micronuciformis
  MG15-120 RuvC-III domain
QDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILNLPTYSPDEEIKTPFVSRMVRHK

SEQ ID NO: 2869 - protein, 167 aa, Unknown; identical to SEQ ID NO: 2763
  Description of Unknown: uncultivated organism with predicted taxonomy: Megasphaera micronuciformis
  MG15-121 RuvC-III domain

SEQ ID NO: 2870 - protein, 153 aa, Unknown; identical to SEQ ID NO: 2772
  Description of Unknown: uncultivated organism with predicted taxonomy: Dialister invisus
  MG15-122 RuvC-III domain

SEQ ID NO: 2871 - protein, 153 aa, Unknown; identical to SEQ ID NO: 2758
  Description of Unknown: uncultivated organism with predicted taxonomy: Megasphaera
  MG15-123 RuvC-III domain

SEQ ID NO: 2872 - protein, 153 aa, Unknown; identical to SEQ ID NO: 2751
  Description of Unknown: uncultivated organism with predicted taxonomy: Dialister
  MG15-124 RuvC-III domain

SEQ ID NO: 2873 - protein, 153 aa, Unknown; identical to SEQ ID NO: 2781
  Description of Unknown: uncultivated organism with predicted taxonomy: Dialister
  MG15-125 RuvC-III domain

SEQ ID NO: 2874 - protein, 167 aa, Unknown
  Description of Unknown: uncultivated organism with predicted taxonomy: Megasphaera stantonii
  MG15-126 RuvC-III domain
QDTQYISRFMLNYLQNNYELTPGNTDRKRRIIPVNGAVTAYVRKRLGISKIRENGDLHHAVDATVIAAVTQGVVNSVSKYSKRHELQYHVDEHGNCVDLVTGKLMGDAFKENHKIKGFPEPWPQFRAELEARVSENAAEAIRTLNLPTYSSDEEIKTPFVSRMVRHK

SEQ ID NO: 2875 - protein, 153 aa, Unknown; identical to SEQ ID NO: 2794
  Description of Unknown: uncultivated organism with predicted taxonomy: Dialister
  MG15-127 RuvC-III domain

SEQ ID NO: 2876 - protein, 153 aa, Unknown; identical to SEQ ID NO: 2794
  Description of Unknown: uncultivated organism with predicted taxonomy: Dialister invisus
  MG15-128 RuvC-III domain

SEQ ID NO: 2877 - protein, 153 aa, Unknown; identical to SEQ ID NO: 2794
  Description of Unknown: uncultivated organism with predicted taxonomy: Dialister
  MG15-129 RuvC-III domain

SEQ ID NO: 2878 - protein, 153 aa, Unknown; identical to SEQ ID NO: 2755
  Description of Unknown: uncultivated organism with predicted taxonomy: Dialister
  MG15-130 RuvC-III domain

SEQ ID NO: 2879 - protein, 153 aa, Unknown; identical to SEQ ID NO: 2797
  Description of Unknown: uncultivated organism with predicted taxonomy: Dialister
  MG15-131 RuvC-III domain

SEQ ID NO: 2880 - protein, 167 aa, Unknown; identical to SEQ ID NO: 2790
  Description of Unknown: uncultivated organism with predicted taxonomy: Veillonella magna
  MG15-132 RuvC-III domain

SEQ ID NO: 2881 - protein, 153 aa, Unknown; identical to SEQ ID NO: 2751
  Description of Unknown: uncultivated organism with predicted taxonomy: Dialister
  MG15-133 RuvC-III domain

SEQ ID NO: 2882 - protein, 167 aa, Unknown; identical to SEQ ID NO: 2766
  Description of Unknown: uncultivated organism with predicted taxonomy: Megasphaera micronuciformis
  MG15-134 RuvC-III domain

SEQ ID NO: 2883 - protein, 167 aa, Unknown; identical to SEQ ID NO: 2766
  Description of Unknown: uncultivated organism with predicted taxonomy: Megasphaera micronuciformis
  MG15-135 RuvC-III domain

SEQ ID NO: 2884 - protein, 146 aa, Unknown
  Description of Unknown: uncultivated organism with predicted taxonomy: Megasphaera stantonii
  MG15-136 RuvC-III domain
QDTQYISKYLYNYLLENLELAKGYTERKRRITPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFV

SEQ ID NO: 2885 - protein, 165 aa, Unknown; identical to SEQ ID NO: 2789
  Description of Unknown: uncultivated organism with predicted taxonomy: Megasphaera sp. AM44-1BH
  MG15-137 RuvC-III domain

SEQ ID NO: 2886 - protein, 165 aa, Unknown
  Description of Unknown: uncultivated organism with predicted taxonomy: Megasphaera
  MG15-138 RuvC-III domain
QDTQYISRYLYNYLRQHIPLKEGYTDRKRRIIPVNGAVTAYVRKRLGISKIRENGDLHHAVDAVIIACVTQGVVNKISCYSKIKELRQFMTADGTIVDKETGEVLQTANPRKTDPFPEPWPKFRQELEARVSDNPAEAIAALGLPTYEGIVSISAPFVSRMPNRK

SEQ ID NO: 2887 - protein, 165 aa, Unknown
  Description of Unknown: uncultivated organism with predicted taxonomy: Megasphaera
  MG15-139 RuvC-III domain
QDTQYISRYLYNYLKRHIELKEGYTDRKRRIIPVNGAVTAYVRKRLGISKIRENGDLHHAVDAVIIACVTQGVVNKISRYSKIKELRQFMTADGMIVDKETGEVLQTANPRKTDPFPEPWPKFRQELEARVSDNPAEAIAALGLPTYEGIVNISAPFVSRMPNRK

SEQ ID NO: 2888 - protein, 165 aa, Unknown
  Description of Unknown: uncultivated organism with predicted taxonomy: Megasphaera sp. AM44-1BH
  MG15-140 RuvC-III domain
QDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEMLTLKHVHKKDPFPEPWPHFRQELEARVGKQPQEAIAALHLPTYENVESIYTPFVSRMPNRK

SEQ ID NO: 2889 - protein, 153 aa, Unknown
  Description of Unknown: uncultivated organism with predicted taxonomy: Dialister
  MG15-141 RuvC-III domain
QDTQYISKYLYNYLRHHLVPAKGYTERKRRIISVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRK

SEQ ID NO: 2890 - protein, 165 aa, Unknown
  Description of Unknown: uncultivated organism with predicted taxonomy: Megasphaera sp. AM44-1BH
  MG15-142 RuvC-III domain
QDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEILTLKHVHKKDLFPEPWPHFRQELVARVGKQPQEAIAALHLPTYENVESIYTPFVSRMPNRK

SEQ ID NO: 2891 - protein, 167 aa, Unknown; identical to SEQ ID NO: 2760
  Description of Unknown: uncultivated organism with predicted taxonomy: Megasphaera micronuciformis
  MG15-143 RuvC-III domain

SEQ ID NO: 2892 - protein, 167 aa, Unknown; identical to SEQ ID NO: 2763
  Description of Unknown: uncultivated organism with predicted taxonomy: Megasphaera stantonii
  MG15-144 RuvC-III domain

SEQ ID NO: 2893 - protein, 167 aa, Unknown
  Description of Unknown: uncultivated organism with predicted taxonomy: Megasphaera stantonii
  MG15-145 RuvC-III domain
QDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWAQFRAELEARVSENAAEAIRILNLPTYSPDEEIKTPFVSRMVRHK

SEQ ID NO: 2894 - protein, 171 aa, Unknown
  Description of Unknown: uncultivated organism with predicted taxonomy: Megasphaera stantonii
  MG15-146 RuvC-III domain
NDTKYISSFVKNLLDDHLEFAPWLTGKNRHVMAVNGAVTDYTRKRLGIRKIREDGDLHHAVDAAVIAIVTQGNIQKLTNYSKQIERSRAFAKNPDGSYSDRETGEILKKDELIVRMSKHFPEPWPGFRRELEARVSDHPKELLESLRLPTYTPEELDALKPPFVSRMPTRK

SEQ ID NO: 2895 - protein, 158 aa, Unknown
  Description of Unknown: uncultivated organism with predicted taxonomy: Selenomonas ruminantium
  MG15-147 RuvC-III domain
NDTRYITKLVKDLIEKYLEMAPFNTNRKRHVVAVNGAVTAYVRKRLGIAKIREDGDLHHAVDAAVIACVTEGMINRISRYSKRREILYNNKLVDEETGEIIKGKEDFPEPWPWFRKELDARTSKNPALLLREMKLPTYTEAELENLREPYVSRMPCHK

SEQ ID NO: 2896 - protein, 146 aa, Unknown
  Description of Unknown: uncultivated organism with predicted taxonomy: Selenomonas sp. AE3005
  MG15-148 RuvC-III domain
NDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWQGFRKELEARTSDNPAEELRRVQVKNYTEEELQAVKPIFVSRMPRRK

SEQ ID NO: 2897 - protein, 158 aa, Unknown
  Description of Unknown: uncultivated organism with predicted taxonomy: Selenomonas ruminantium
  MG15-149 RuvC-III domain
NDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKGKEDFPEPWPWFRKELDARTSKNPALLIRGLKLPTYAEEELENLHEPYVSRMPCHK

SEQ ID NO: 2898 - protein, 171 aa, Unknown
  Description of Unknown: uncultivated organism with predicted taxonomy: Selenomonas ruminantium
  MG15-150 RuvC-III domain
TDTKYIGSFVANLLRDHLDFAPWLNGRKQHVLVVNGAVTDYTRKRLGIRKIREDGDLHHAVDAAVIATVTQGNIQKLTNYSKQIERSRAFDKTANGSYADRETGEVLKKDELMVRMSKHFPEPWPGFRHELEARVSDHPKELLESLRLPTYTPEELDALKPPFVSRMPTRK

SEQ ID NO: 2899 - protein, 146 aa, Unknown
  Description of Unknown: uncultivated organism with predicted taxonomy: Selenomonas sp. AE3005
  MG15-151 RuvC-III domain
NDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWPGFRKELEARTSDNPAEELRRVQVKNYTEEELQAVKPIFVSRMPRRK

SEQ ID NO: 2900 - protein, 146 aa, Unknown
  Description of Unknown: uncultivated organism with predicted taxonomy: Selenomonas sp. AE3005
  MG15-152 RuvC-III domain
NDTKYISRFVYNLLRNHLEFNPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALKPIFVSRMPRRK

SEQ ID NO: 2901 - protein, 146 aa, Unknown
  Description of Unknown: uncultivated organism with predicted taxonomy: Selenomonas sp. AE3005
  MG15-153 RuvC-III domain
NDTKYISRFVYNLLRNHLEFSPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALNPIFVSRMPRRK

SEQ ID NO: 2902 - protein, 158 aa, Unknown
  Description of Unknown: uncultivated organism with predicted taxonomy: Selenomonas ruminantium
  MG15-154 RuvC-III domain
NDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKEKEDFPEPWPWFRKELDARTSKNPALLIRELKLPTYAEEELENLHEPYVSRMPCHK

SEQ ID NO: 2903 - protein, 146 aa, Unknown
  Description of Unknown: uncultivated organism with predicted taxonomy: Selenomonas sp. AE3005
  MG15-155 RuvC-III domain
NDTKYISRFVYNLLRNHLEFSPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALKPIFVSRMPRRK

SEQ ID NO: 2904 - protein, 146 aa, Unknown; identical to SEQ ID NO: 2899
  Description of Unknown: uncultivated organism with predicted taxonomy: Selenomonas sp. AE3005
  MG15-156 RuvC-III domain

SEQ ID NO: 2905 - protein, 169 aa, Unknown
  Description of Unknown: uncultivated organism with predicted taxonomy: Megasphaera stantonii
  MG15-157 RuvC-III domain
NDTKYISSFVKNLLEDHLEFAPWLTGRKRHVMAVNGAVTDYTRKRLGIRKIREDGDLHHAVDAAVIAIVTQGNIQKLTNYSKRIEHAFIKNRDGSYTHPDTGEILKKDELMAQMSRHFPEPWPGFRRELEARVSDHPKELLESLRLPTYTPEEIDALKPPFVSRMPTRK

SEQ ID NO: 2906 - protein, 158 aa, Unknown
  Description of Unknown: uncultivated organism with predicted taxonomy: Selenomonas ruminantium
  MG15-158 RuvC-III domain
NDTRYITKLVKDIIEKYLEMAPFKTTRKRNVVAVNGAVTAYVRKRLGIAKIRENGDLHHAVDAAVIACVTEGMINRISRYSKRREILYNNKLVDEETGEIIKGKEDFPEPWPWFRKELDARTGKNPALLIRDLKLPTYTEAELENLHEPYVSRMPCHK

SEQ ID NO: 2907 - protein, 158 aa, Unknown
  Description of Unknown: uncultivated organism with predicted taxonomy: Selenomonas ruminantium
  MG15-159 RuvC-III domain
NDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKEKEDFPEPWPWFRKELDARTSKNPALLTRELKLPTYAEEELENLHEPYVSRMPCHK

SEQ ID NO: 2908 - protein, 169 aa, Unknown
  Description of Unknown: uncultivated organism with predicted taxonomy: Megasphaera stantonii
  MG15-160 RuvC-III domain
NDTKYISSFVKNLLEDHLEFAPWLTGKKRHVMAVNGAVTDYTRKRLGIRKIREDGDLHHAVDAAVIAIVTQGNIQKLTNYSKRIEHAFIKNRDGSYTHPDTGEILKKGELMAQMSRHFPEPWPGFRRELEARVSDHPKALLESLRLPTYTPEELDALKPPFVSRMPTRK

SEQ ID NO: 2909 - protein, 170 aa, Unknown; identical to SEQ ID NO: 2786
  Description of Unknown: uncultivated organism with predicted taxonomy: Selenomonas sp. AE3005
  MG15-161 RuvC-III domain

SEQ ID NO: 2910 - protein, 153 aa, Unknown; identical to SEQ ID NO: 2751
  Description of Unknown: uncultivated organism with predicted taxonomy: Megasphaera
  MG15-162 RuvC-III domain

SEQ ID NO: 2911 - protein, 153 aa, Unknown
  Description of Unknown: uncultivated organism with predicted taxonomy: Megasphaera stantonii
  MG15-163 RuvC-III domain
QDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRK

SEQ ID NO: 2912 - protein, 153 aa, Unknown; identical to SEQ ID NO: 2762
  Description of Unknown: uncultivated organism with predicted taxonomy: Megasphaera
  MG15-164 RuvC-III domain

SEQ ID NO: 2913 - protein, 153 aa, Unknown; identical to SEQ ID NO: 2751
  Description of Unknown: uncultivated organism with predicted taxonomy: Megasphaera stantonii
  MG15-165 RuvC-III domain

SEQ ID NO: 2914 - protein, 162 aa, Unknown
  Description of Unknown: uncultivated organism with predicted taxonomy: Bacteroidales
  MG16-2 RuvC-III domain
RETQYIAKKSVEILKQICRNVWTTSGSVTDFLRHNWGYDEILHTLDFDRYKSGGLTEVIEIEHKGQKHRIERIKDWSKRLDHRHHAVDALVVACTKQSYIQRLNNLNTERDAMYQDIEAQSVEWKEKHSLLEKWIKLQPHPTVSEVTDKVDEILVSFKAGKR

SEQ ID NO: 2915 - protein, 165 aa, Unknown
  Description of Unknown: uncultivated organism with predicted taxonomy: Bacteroidales
  MG16-5 RuvC-III domain
LQSQYIAKKAAEILRQGYRNVYATSGSVTDFLRHQWGYDEILHRLNLPRYQQVEGLTEDVTYDHCGQEHQQERIKGWTKRLDHRHHAIDALTIALTQQSVIQRLNTLNNSREQMFDELGKRTDTPEYTEKRSLLEKWVDAQPHFSVQEVTDKVDGILVSFRAGKR

SEQ ID NO: 2916 - protein, 165 aa, Unknown; identical to SEQ ID NO: 2915
  Description of Unknown: uncultivated organism with predicted taxonomy: Bacteroidetes
  MG16-6 RuvC-III domain

SEQ ID NO: 2917 - protein, 150 aa, Unknown
  Description of Unknown: uncultivated organism with predicted taxonomy: Bacteroides
  MG16-7 RuvC-III domain
VQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKK

SEQ ID NO: 2918 - protein, 150 aa, Unknown; identical to SEQ ID NO: 2917
  Description of Unknown: uncultivated organism with predicted taxonomy: Bacteroides
  MG16-8 RuvC-III domain

SEQ ID NO: 2919 - protein, 150 aa, Unknown; identical to SEQ ID NO: 2917
  Description of Unknown: uncultivated organism with predicted taxonomy: Bacteroides sp. CAG:770
  MG16-9 RuvC-III domain

SEQ ID NO: 2920 - protein, 150 aa, Unknown; identical to SEQ ID NO: 2917
  Description of Unknown: uncultivated organism with predicted taxonomy: Bacteroides
  MG16-10 RuvC-III domain

SEQ ID NO: 2921 - protein, 150 aa, Unknown; identical to SEQ ID NO: 2917
  Description of Unknown: uncultivated organism with predicted taxonomy: Bacteroides
  MG16-11 RuvC-III domain

SEQ ID NO: 2922 - protein, 165 aa, Unknown; identical to SEQ ID NO: 2915
  Description of Unknown: uncultivated organism with predicted taxonomy: Bacteroidetes
  MG16-12 RuvC-III domain

SEQ ID NO: 2923 - protein, 150 aa, Unknown; identical to SEQ ID NO: 2917
  Description of Unknown: uncultivated organism with predicted taxonomy: Bacteroides
  MG16-13 RuvC-III domain

SEQ ID NO: 2924 - protein, 150 aa, Unknown; identical to SEQ ID NO: 2917
  Description of Unknown: uncultivated organism with predicted taxonomy: Bacteroides sp. CAG:770
  MG16-14 RuvC-III domain

SEQ ID NO: 2925 - protein, 150 aa, Unknown
  Description of Unknown: uncultivated organism with predicted taxonomy: Bacteroides sp. CAG:770
  MG16-15 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2926 - protein, 150 aa, Unknown
  Description of Unknown: uncultivated organism with predicted taxonomy: Bacteroides sp. CAG:709
  MG16-16 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDNVSQILVSFKAGKK

SEQ ID NO: 2927 - protein, 150 aa, Unknown
  Description of Unknown: uncultivated organism with predicted taxonomy: Bacteroides sp. CAG:770
  MG16-17 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTQQSIIQRLNNLSAMTAVAGESMSLDKWTLAQPHFSVQKVSDNVSRILVSFKAGKK

SEQ ID NO: 2928 - protein, 150 aa, Unknown
  Description of Unknown: uncultivated organism with predicted taxonomy: Bacteroides sp. CAG:770
  MG16-18 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKTAIGEEQISLDKWTLAQAHFSVADVADHVADILVSFKSGKK

SEQ ID NO: 2929 - protein, 150 aa, Unknown
  Description of Unknown: uncultivated organism with predicted taxonomy: Bacteroides sp. CAG:770
  MG16-19 RuvC-III domain
VQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKR

SEQ ID NO: 2930 - protein, 150 aa, Unknown
  Description of Unknown: uncultivated organism with predicted taxonomy: Bacteroides sp. CAG:770
  MG16-20 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMSAVAGESMSLDKWTLAQPHFSVQEVSDNVSRILVSFKAGKK

SEQ ID NO: 2931 - protein, 150 aa, Unknown
  Description of Unknown: uncultivated organism with predicted taxonomy: Bacteroides sp. CAG:770
  MG16-21 RuvC-III domain
VQTQYVSRKAMEILNQVCRNVYGSSGDVTAYLRRIWGYDEILHSLDLPRYREGNLTGNVTYVHRGQTHTEERIRDWSKRLDHRHHAIDALTIACTRQSIIQRLNTLNAKTAIGEEQMSLDKWTLAQAHFSVADVADHVADILVSFKSGKK

SEQ ID NO: 2932 - protein, 150 aa, Unknown
  Description of Unknown: uncultivated organism with predicted taxonomy: Bacteroides sp. CAG:770
  MG16-22 RuvC-III domain
VQTQYISRKAMEILNQVCRNVYGSSGDVTAYLRRIWGYDEILHSLDLPRYRKGNLTGDVTYVHKGQTHTEERIKDWSKRLDHRHHAIDALTIACTRQSIIQRLNTLNAKTAIGEEQMSLDKWTLAQAHFSVADVADHVADILVSFKSGKR

SEQ ID NO: 2933 - protein, 150 aa, Unknown
  Description of Unknown: uncultivated organism with predicted taxonomy: Bacteroidales
  MG16-23 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNRSAMTAVAGESMSLDKWTLAQPHFSVQEVSDNVSRILVSFKAGKK

SEQ ID NO: 2934 - protein, 150 aa, Unknown
  Description of Unknown: uncultivated organism with predicted taxonomy: Bacteroides sp. CAG:770
  MG16-24 RuvC-III domain
VQTQYISRKAMEILKQVCHNVYGSSGEVTSYLRRIWGYDEILHALDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2935 - protein, 150 aa, Unknown
  Description of Unknown: uncultivated organism with predicted taxonomy: Bacteroides sp. CAG:770
  MG16-25 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKK

SEQ ID NO: 2936 - protein, 150 aa, Unknown; identical to SEQ ID NO: 2925
  Description of Unknown: uncultivated organism with predicted taxonomy: Bacteroides
  MG16-26 RuvC-III domain

SEQ ID NO: 2937 - protein, 150 aa, Unknown
  Description of Unknown: uncultivated organism with predicted taxonomy: Bacteroides sp. CAG:770
  MG16-27 RuvC-III domain
VQTQYISRKAMEILDQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKK

SEQ ID NO: 2938 - protein, 150 aa, Unknown
  Description of Unknown: uncultivated organism with predicted taxonomy: Bacteroides sp. CAG:545
  MG16-28 RuvC-III domain
VQTQYISRKAMEILKQVCHNVYGSSGEVTSYLRRIWGYDEILHTLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2939 - protein, 150 aa, Unknown
  Description of Unknown: uncultivated organism with predicted taxonomy: Bacteroides sp. CAG:709
  MG16-29 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKK

SEQ ID NO: 2940 - protein, 150 aa, Unknown; identical to SEQ ID NO: 2939
  Description of Unknown: uncultivated organism with predicted taxonomy: Bacteroides sp. CAG:709
  MG16-30 RuvC-III domain

SEQ ID NO: 2941 - protein, 150 aa, Unknown; identical to SEQ ID NO: 2939
  Description of Unknown: uncultivated organism with predicted taxonomy: Bacteroides sp. CAG:709
  MG16-31 RuvC-III domain

SEQ ID NO: 2942 - protein, 150 aa, Unknown
  Description of Unknown: uncultivated organism with predicted taxonomy: Alistipes sp. CAG:514
  MG16-32 RuvC-III domain
VQTQYISRKAMEILKQVCHNVYGSSGEVTSYLRRIWGYDEILHSLDLPRYREGGMTTEVSYEHRGQTHTEERIKDWSKRLDHRHHAIDALTIACTRQSIIQRLNNLSSMTATAGESMSLDKWTSAQPHFSVQEVSDNVSRILVSFKAGKK

SEQ ID NO: 2943 - protein, 150 aa, Unknown; identical to SEQ ID NO: 2942
  Description of Unknown: uncultivated organism with predicted taxonomy: Alistipes sp. CAG:514
  MG16-33 RuvC-III domain

SEQ ID NO: 2944 - protein, 150 aa, Unknown; identical to SEQ ID NO: 2925
  Description of Unknown: uncultivated organism with predicted taxonomy: Bacteroides sp. CAG:545
  MG16-34 RuvC-III domain

SEQ ID NO: 2945 - protein, 150 aa, Unknown
  Description of Unknown: uncultivated organism with predicted taxonomy: Bacteroides sp. CAG:770
  MG16-35 RuvC-III domain
VQTQYISRKAMEILNQVCRNVYGSSGDVTAYLRRIWGYDEILHSLDLPRYREGNLTGDVTYVHKGQTHTEERIKDWSKRLDHRHHAIDALTIACTRQSIIQKLNTLNAKTAIGEEQISLDKWTLAQAHFSVADVADHVADILVSFKSGKK

SEQ ID NO: 2946 - protein, 150 aa, Unknown
  Description of Unknown: uncultivated organism with predicted taxonomy: Bacteroides
  MG16-36 RuvC-III domain
VQTQYISRKAMEILKQVCHNVYGSSGEVTSYLRRIWGYDKILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2947 - protein, 150 aa, Unknown; identical to SEQ ID NO: 2925
  Description of Unknown: uncultivated organism with predicted taxonomy: Bacteroides sp. CAG:545
  MG16-37 RuvC-III domain

SEQ ID NO: 2948 - protein, 150 aa, Unknown; identical to SEQ ID NO: 2946
  Description of Unknown: uncultivated organism with predicted taxonomy: Bacteroides
  MG16-38 RuvC-III domain

SEQ ID NO: 2949 - protein, 150 aa, Unknown; identical to SEQ ID NO: 2929
  Description of Unknown: uncultivated organism with predicted taxonomy: Bacteroides sp. CAG:770
  MG16-39 RuvC-III domain

SEQ ID NO: 2950 - protein, 150 aa, Unknown
  Description of Unknown: uncultivated organism with predicted taxonomy: Bacteroides sp. CAG:770
  MG16-40 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSIIQRLNNLSSMTAVAGEAMSLDKWTLAQPHFSVQEVSDKVGGILVSFKAGKK

SEQ ID NO: 2951 - protein, 150 aa, Unknown
  Description of Unknown: uncultivated organism with predicted taxonomy: Bacteroides sp. CAG:770
  MG16-42 RuvC-III domain
VQTQYISRKAMEILNQVCRNVYGSSGDVTAYLRRIWGYDEILHSLDLPRYREGNLTGDVTYVHMGQTHTEERIKDWSKRLDHRHHAIDALTIACTRQSIIQRLNTLNAKTAIGEEQMSLDKWTLAQAHFSVADVSDHVADILVSFKSGKK

SEQ ID NO: 2952 - protein, 150 aa, Unknown; identical to SEQ ID NO: 2951
  Description of Unknown: uncultivated organism with predicted taxonomy: Bacteroides sp. CAG:770
  MG16-43 RuvC-III domain

SEQ ID NO: 2953 - protein, 150 aa, Unknown
  Description of Unknown: uncultivated organism with predicted taxonomy: Bacteroides sp. CAG:770
  MG16-44 RuvC-III domain
VQTQYISRKAMEILNQVCRNVYGSSGDVTAYLRRIWGYDEILHYLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKK

SEQ ID NO: 2954 - protein, 150 aa, Unknown; identical to SEQ ID NO: 2945
  Description of Unknown: uncultivated organism with predicted taxonomy: Bacteroides sp. CAG:770
  MG16-45 RuvC-III domain

SEQ ID NO: 2955 - protein, 150 aa, Unknown; identical to SEQ ID NO: 2925
  Description of Unknown: uncultivated organism with predicted taxonomy: Bacteroides sp. CAG:770
  MG16-46 RuvC-III domain

SEQ ID NO: 2956 - protein, 150 aa, Unknown; identical to SEQ ID NO: 2939
  Description of Unknown: uncultivated organism with predicted taxonomy: Bacteroides sp. CAG:709
  MG16-47 RuvC-III domain

SEQ ID NO: 2957 - protein, 150 aa, Unknown
  Description of Unknown: uncultivated organism with predicted taxonomy: Bacteroides sp. CAG:770
  MG16-48 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNAKTAIGEEQISLDKWTLAQAHFSVADVADHVADILVSFKSGKK

SEQ ID NO: 2958 - protein, 150 aa, Unknown; identical to SEQ ID NO: 2957
  Description of Unknown: uncultivated organism with predicted taxonomy: Bacteroides sp. CAG:770
  MG16-50 RuvC-III domain

SEQ ID NO: 2959 - protein, 150 aa, Unknown; identical to SEQ ID NO: 2957
  Description of Unknown: uncultivated organism with predicted taxonomy: Bacteroides sp. CAG:770
  MG16-51 RuvC-III domain

SEQ ID NO: 2960 - protein, 150 aa, Unknown
  Description of Unknown: uncultivated organism with predicted taxonomy: Bacteroides sp. CAG:770
  MG16-52 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKK

SEQ ID NO: 2961 - protein, 150 aa, Unknown; identical to SEQ ID NO: 2939
  Description of Unknown: uncultivated organism with predicted taxonomy: Bacteroides sp. CAG:709
  MG16-53 RuvC-III domain

SEQ ID NO: 2962 - protein, 150 aa, Unknown; identical to SEQ ID NO: 2939
  Description of Unknown: uncultivated organism with predicted taxonomy: Bacteroides sp. CAG:709
  MG16-54 RuvC-III domain

SEQ ID NO: 2963 - protein, 150 aa, Unknown
  Description of Unknown: uncultivated organism with predicted taxonomy: Bacteroides sp. CAG:770
  MG16-55 RuvC-III domain
VQTQYISRKAMDILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKAAIGEEQMSLDKWTLAQAHFSVADVADHVADILVSFKSGKK

SEQ ID NO: 2964 - protein, 150 aa, Unknown; identical to SEQ ID NO: 2925
  Description of Unknown: uncultivated organism with predicted taxonomy: Bacteroides sp. CAG:545
  MG16-56 RuvC-III domain

SEQ ID NO: 2965 - protein, 150 aa, Unknown; identical to SEQ ID NO: 2929
  Description of Unknown: uncultivated organism with predicted taxonomy: Bacteroides sp. CAG:770
  MG16-57 RuvC-III domain

SEQ ID NO: 2966 - protein, 150 aa, Unknown
  Description of Unknown: uncultivated organism with predicted taxonomy: Bacteroides sp. CAG:770
  MG16-58 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVAGILVSFKSGKR

SEQ ID NO: 2967 - protein, 150 aa, Unknown
  Description of Unknown: uncultivated organism with predicted taxonomy: Bacteroides sp. CAG:770
  MG16-59 RuvC-III domain
VQTQYISRKAMEILKQVCHNVYGSSGEVTSYLRRIWGYDEILHSLDLPRYREGGMTAEVSYDHRGQTHTEERIKDWSKRLEHRHHAIDALTIACTRQSIIQRLNNLSAMTAVAGESMSLDKWTLAQPHFSVQEVSDNVSRILVSFKAGKK

SEQ ID NO: 2968 - protein, 150 aa, Unknown; identical to SEQ ID NO: 2925
  Description of Unknown: uncultivated organism with predicted taxonomy: Bacteroides sp. CAG:770
  MG16-60 RuvC-III domain

SEQ ID NO: 2969 - protein, 150 aa, Unknown; identical to SEQ ID NO: 2939
  Description of Unknown: uncultivated organism with predicted taxonomy: Bacteroides sp. CAG:709
  MG16-61 RuvC-III domain

SEQ ID NO: 2970 - protein, 150 aa, Unknown; identical to SEQ ID NO: 2925
  Description of Unknown: uncultivated organism with predicted taxonomy: Bacteroides sp. CAG:770
  MG16-62 RuvC-III domain

SEQ ID NO: 2971 - protein, 150 aa, Unknown; identical to SEQ ID NO: 2925
  Description of Unknown: uncultivated organism with predicted taxonomy: Bacteroides sp. CAG:770
  MG16-63 RuvC-III domain

SEQ ID NO: 2972 - protein, 150 aa, Unknown; identical to SEQ ID NO: 2942
  Description of Unknown: uncultivated organism with predicted taxonomy: Alistipes sp. CAG:514
  MG16-64 RuvC-III domain

SEQ ID NO: 2973 - protein, 150 aa, Unknown
  Description of Unknown: uncultivated organism with predicted taxonomy: Bacteroides sp. CAG:770
  MG16-65 RuvC-III domain
VQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKK

SEQ ID NO: 2974 - protein, 150 aa, Unknown
  Description of Unknown: uncultivated organism with predicted taxonomy: Bacteroides sp. CAG:770
  MG16-66 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGEYMSLDKWTLAQPHFSVQEVSDNVSRILVSFKAGKK

SEQ ID NO: 2975 - protein, 150 aa, Unknown; identical to SEQ ID NO: 2925
  Description of Unknown: uncultivated organism with predicted taxonomy: Bacteroides sp. CAG:545
  MG16-67 RuvC-III domain

SEQ ID NO: 2976 - protein, 150 aa, Unknown; identical to SEQ ID NO: 2930
  Description of Unknown: uncultivated organism with predicted taxonomy: Bacteroides sp. CAG:770
  MG16-68 RuvC-III domain

SEQ ID NO: 2977 - protein, 150 aa, Unknown; identical to SEQ ID NO: 2939
  Description of Unknown: uncultivated organism with predicted taxonomy: Bacteroides sp. CAG:709
  MG16-69 RuvC-III domain

SEQ ID NO: 2978 - protein, 150 aa, Unknown; identical to SEQ ID NO: 2925
  Description of Unknown: uncultivated organism with predicted taxonomy: Bacteroides sp. CAG:770
  MG16-70 RuvC-III domain

SEQ ID NO: 2979 - protein, 150 aa, Unknown; identical to SEQ ID NO: 2938
  Description of Unknown: uncultivated organism with predicted taxonomy: Bacteroides sp. CAG:545
  MG16-72 RuvC-III domain

SEQ ID NO: 2980 - protein, 150 aa, Unknown; identical to SEQ ID NO: 2925
  Description of Unknown: uncultivated organism with predicted taxonomy: Bacteroides sp. CAG:545
  MG16-73 RuvC-III domain

SEQ ID NO: 2981 - protein, 150 aa, Unknown
  Description of Unknown: uncultivated organism with predicted taxonomy: Bacteroides sp. CAG:770
  MG16-74 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNANTAIGEEQISLDKWTLAQAHFSVADVADHVADILVSFKSGKK

SEQ ID NO: 2982 - protein, 150 aa, Unknown; identical to SEQ ID NO: 2939
  Description of Unknown: uncultivated organism with predicted taxonomy: Bacteroides sp. CAG:709
  MG16-75 RuvC-III domain

SEQ ID NO: 2983 - protein, 150 aa, Unknown; identical to SEQ ID NO: 2939
  Description of Unknown: uncultivated organism with predicted taxonomy: Bacteroides
  MG16-76 RuvC-III domain

SEQ ID NO: 2984 - protein, 150 aa, Unknown
  Description of Unknown: uncultivated organism with predicted taxonomy: Bacteroides sp. CAG:770
  MG16-77 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKR

SEQ ID NO: 2985 - protein, 150 aa, Unknown; identical to SEQ ID NO: 2925
  Description of Unknown: uncultivated organism with predicted taxonomy: Bacteroides
  MG16-78 RuvC-III domain

SEQ ID NO: 2986 - protein, 150 aa, Unknown
  Description of Unknown: uncultivated organism with predicted taxonomy: Bacteroides sp. CAG:770
  MG16-79 RuvC-III domain
IQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2987 - protein, 150 aa, Unknown; identical to SEQ ID NO: 2925
  Description of Unknown: uncultivated organism with predicted taxonomy: Bacteroides sp. CAG:545
  MG16-80 RuvC-III domain

SEQ ID NO: 2988 - protein, 150 aa, Unknown
  Description of Unknown: uncultivated organism with predicted taxonomy: Bacteroides
  MG16-81 RuvC-III domain
VQTQYISRKAMEILKQVCHNVYGSSGEVTSYLRRIWGYDVILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKK

SEQ ID NO: 2989 - protein, 150 aa, Unknown; identical to SEQ ID NO: 2930
  Description of Unknown: uncultivated organism with predicted taxonomy: Bacteroides sp. CAG:770
  MG16-82 RuvC-III domain

SEQ ID NO: 2990 - protein, 150 aa, Unknown; identical to SEQ ID NO: 2925
  Description of Unknown: uncultivated organism with predicted taxonomy: Bacteroides sp. CAG:545
  MG16-83 RuvC-III domain

SEQ ID NO: 2991 - protein, 165 aa, Unknown
  Description of Unknown: uncultivated organism with predicted taxonomy: Bacteroidetes
  MG16-84 RuvC-III domain
RQSQYIAKKAAEILRQGVRNVYATSGSVTDFLRHQWGYDNILHYLNLPRYQQVDGLTESVTYDHCGQKHQEERIKDWTKRLDHRHHAIDALTIALTQQSVIQRLNTLNASREEMKNDLGQRIDTPEYTEKRSLLEKWVDIQPHFSVQEVTDKVDGILISFRAGKR

SEQ ID NO: 2992 - protein, 150 aa, Unknown; identical to SEQ ID NO: 2925
  Description of Unknown: uncultivated organism with predicted taxonomy: Bacteroides
  MG16-85 RuvC-III domain

SEQ ID NO: 2993 - protein, 150 aa, Unknown
  Description of Unknown: uncultivated organism with predicted taxonomy: Bacteroides sp. CAG:545
  MG16-86 RuvC-III domain
VQTQYISRKAMEILKQVCHNVYGSSGEVTSYLRRIWGYDEILHSLDLPRYREGGMTAEVSYDHLGQTHTEERIKDWSKRLDHRHHAIDALTIACTRQSIIQRLNNLSAMSAVAGESMSLDKWTLAQPHFSVQEVSDNVSRILVSFKAGKK

SEQ ID NO: 2994 - protein, 150 aa, Unknown; identical to SEQ ID NO: 2993
  Description of Unknown: uncultivated organism with predicted taxonomy: Bacteroides
  MG16-87 RuvC-III domain

SEQ ID NO: 2995 - protein, 150 aa, Unknown; identical to SEQ ID NO: 2926
  Description of Unknown: uncultivated organism with predicted taxonomy: Bacteroides
  MG16-88 RuvC-III domain

SEQ ID NO: 2996 - protein, 150 aa, Unknown; identical to SEQ ID NO: 2939
  Description of Unknown: uncultivated organism with predicted taxonomy: Bacteroides sp. CAG:709
  MG16-89 RuvC-III domain

SEQ ID NO: 2997 - protein, 150 aa, Unknown; identical to SEQ ID NO: 2966
  Description of Unknown: uncultivated organism with predicted taxonomy: Bacteroides sp. CAG:770
  MG16-90 RuvC-III domain

SEQ ID NO: 2998 - protein, 150 aa, Unknown; identical to SEQ ID NO: 2966
  Description of Unknown: uncultivated organism with predicted taxonomy: Bacteroides sp. CAG:770
  MG16-91 RuvC-III domain

SEQ ID NO: 2999 - protein, 150 aa, Unknown; identical to SEQ ID NO: 2942
  Description of Unknown: uncultivated organism with predicted taxonomy: Alistipes sp. CAG:514
  MG16-92 RuvC-III domain

SEQ ID NO: 3000 - protein, 150 aa, Unknown; identical to SEQ ID NO: 2942
  Description of Unknown: uncultivated organism with predicted taxonomy: Alistipes sp. CAG:514
  MG16-93 RuvC-III domain

SEQ ID NO: 3001 - protein, 150 aa, Unknown
  Description of Unknown: uncultivated organism with predicted taxonomy: Bacteroides sp. CAG:545
  MG16-94 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSYNVSRILVSFKAGKK

SEQ ID NO: 3002 - protein, 150 aa, Unknown
  Description of Unknown: uncultivated organism with predicted taxonomy: Bacteroides sp. CAG:709
  MG16-95 RuvC-III domain
VQTQYISRKAMEILKQVCHNVYGSSGEVTSYLRRIWGYDEILHSLDLPRYREGGMTAEVSYEHRGQIHTEERIKDWSKRLDHRHHAIDALTIACTRQSVIQRLNNLSSMTAVAGEAMSLDKWTLAQPHFSVQEVSDKVGGILVSFKAGKK

SEQ ID NO: 3003 - protein, 150 aa, Unknown; identical to SEQ ID NO: 2925
  Description of Unknown: uncultivated organism with predicted taxonomy: Bacteroides
  MG16-96 RuvC-III domain

SEQ ID NO: 3004 - protein, 150 aa, Unknown; identical to SEQ ID NO: 2925
  Description of Unknown: uncultivated organism with predicted taxonomy: Bacteroides
  MG16-97 RuvC-III domain

SEQ ID NO: 3005 - protein, 150 aa, Unknown
  Description of Unknown: uncultivated organism with predicted taxonomy: Bacteroides sp. CAG:770
  MG16-98 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKK

SEQ ID NO: 3006 - protein, 150 aa, Unknown; identical to SEQ ID NO: 2939
  Description of Unknown: uncultivated organism with predicted taxonomy: Bacteroides sp. CAG:709
  MG16-99 RuvC-III domain

SEQ ID NO: 3007 - protein, 150 aa, Unknown; identical to SEQ ID NO: 2939
  Description of Unknown: uncultivated organism with predicted taxonomy: Bacteroides sp. CAG:709
  MG16-100 RuvC-III domain

SEQ ID NO: 3008 - protein, 150 aa, Unknown
  Description of Unknown: uncultivated organism with predicted taxonomy: Bacteroides sp. CAG:545
  MG16-101 RuvC-III domain
VQTQYISRKAMEILKQVCHNVYGSSGEVTSYLRRIWGYDEILHSLDLPRYREGGMTSEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 3009 - protein, 150 aa, Unknown
  Description of Unknown: uncultivated organism with predicted taxonomy: Bacteroides sp. CAG:770
  MG16-102 RuvC-III domain
VQTQYISRKAMEILNQVCRNVYCSSGDVTAYLRRIWGYDEILHSLDLPRYREGNLTGDVTYVHMGQTHTEERIKDWSKRMDHRHHAIDALTIACTRQSIIQRLNTLNAKTAIGEEQMSLDKWTLAQAHFSVADVADHVADILVSFKSGKR

SEQ ID NO: 3010 - protein, 150 aa, Unknown; identical to SEQ ID NO: 2953
  Description of Unknown: uncultivated organism with predicted taxonomy: Bacteroides sp. CAG:770
  MG16-103 RuvC-III domain

SEQ ID NO: 3011 - protein, 150 aa, Unknown; identical to SEQ ID NO: 2939
  Description of Unknown: uncultivated organism with predicted taxonomy: Bacteroides
  MG16-104 RuvC-III domain

SEQ ID NO: 3012 - protein, 150 aa, Unknown
  Description of Unknown: uncultivated organism with predicted taxonomy: Bacteroides sp. CAG:770
  MG16-105 RuvC-III domain
VQTQYISRKAMEILNQVCRNVYGSSGDVTAYLRRIWGYDEILHSLDLPRYREGNLTENVTYVHRGQTHTEERIKDWSKRLDHRHHAIDALTIACTRQSIIQRLNTLNAKTAIGEEQMSLDKWTLAQTHFSVADVADHVADILVSFKSGKR

SEQ ID NO: 3013 - protein, 150 aa, Unknown; identical to SEQ ID NO: 2925
  Description of Unknown: uncultivated organism with predicted taxonomy: Bacteroides sp. CAG:545
  MG16-106 RuvC-III domain

SEQ ID NO: 3014 - protein, 150 aa, Unknown; identical to SEQ ID NO: 2925
  Description of Unknown: uncultivated organism with predicted taxonomy: Bacteroides sp. CAG:545
  MG16-107 RuvC-III domain

SEQ ID NO: 3015 - protein, 150 aa, Unknown; identical to SEQ ID NO: 2932
  Description of Unknown: uncultivated organism with predicted taxonomy: Bacteroides sp. CAG:770
  MG16-108 RuvC-III domain

SEQ ID NO: 3016 - protein, 150 aa, Unknown; identical to SEQ ID NO: 2939
  Description of Unknown: uncultivated organism with predicted taxonomy: Bacteroides sp. CAG:709
  MG16-109 RuvC-III domain

SEQ ID NO: 3017 - protein, 150 aa, Unknown; identical to SEQ ID NO: 2939
  Description of Unknown: uncultivated organism with predicted taxonomy: Bacteroides sp. CAG:709
  MG16-110 RuvC-III domain

SEQ ID NO: 3018 - protein, 150 aa, Unknown; identical to SEQ ID NO: 2925
  Description of Unknown: uncultivated organism with predicted taxonomy: Bacteroides sp. CAG:770
  MG16-113 RuvC-III domain

SEQ ID NO: 3019 - protein, 150 aa, Unknown; identical to SEQ ID NO: 2925
  Description of Unknown: uncultivated organism with predicted taxonomy: Bacteroides sp. CAG:545
  MG16-114 RuvC-III domain

SEQ ID NO: 3020 - protein, 150 aa, Unknown; identical to SEQ ID NO: 2925
  Description of Unknown: uncultivated organism with predicted taxonomy: Bacteroides sp. CAG:770
  MG16-115 RuvC-III domain

SEQ ID NO: 3021 - protein, 150 aa, Unknown; identical to SEQ ID NO: 2925
  Description of Unknown: uncultivated organism with predicted taxonomy: Bacteroides
  MG16-116 RuvC-III domain

SEQ ID NO: 3022 - protein, 150 aa, Unknown; identical to SEQ ID NO: 2973
  Description of Unknown: uncultivated organism with predicted taxonomy: Bacteroides sp. CAG:770
  MG16-118 RuvC-III domain

SEQ ID NO: 3023 - protein, 150 aa, Unknown; identical to SEQ ID NO: 2939
  Description of Unknown: uncultivated organism with predicted taxonomy: Bacteroides sp. CAG:709
  MG16-119 RuvC-III domain

SEQ ID NO: 3024 - protein, 150 aa, Unknown; identical to SEQ ID NO: 2939
  Description of Unknown: uncultivated organism with predicted taxonomy: Bacteroides sp. CAG:709
  MG16-120 RuvC-III domain

SEQ ID NO: 3025 - protein, 150 aa, Unknown
  Description of Unknown: uncultivated organism with predicted taxonomy: Bacteroides sp. CAG:770
  MG16-121 RuvC-III domain
VQTQYISRKAMEILNQVCRNVYGSSGDVTAYLRRIWGYDEILHSLDLPRYREGNLTGDVTYLHKGQTHTEERIKDWSKRLDHRHHAIDALTIASTRQSIIQRLNTLNAKTAIGEEQISLDKWTLAQAHFSVADVADHVADILVSFKSGKK

SEQ ID NO: 3026 - protein, 150 aa, Unknown
  Description of Unknown: uncultivated organism with predicted taxonomy: Bacteroides sp. CAG:770
  MG16-122 RuvC-III domain
VQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKR

SEQ ID NO: 3027 - protein, 150 aa, Unknown; identical to SEQ ID NO: 2925
  Description of Unknown: uncultivated organism with predicted taxonomy: Bacteroides sp. CAG:545
  MG16-123 RuvC-III domain

SEQ ID NO: 3028 - protein, 150 aa, Unknown
  Description of Unknown: uncultivated organism with predicted taxonomy: Bacteroides sp. CAG:770
  MG16-126 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMAAVAGESMSLDKWTLAQPHFSVQEVSDNVSRILVSFKAGKK

SEQ ID NO: 3029 - protein, 150 aa, Unknown; identical to SEQ ID NO: 2939
  Description of Unknown: uncultivated organism with predicted taxonomy: Bacteroides sp. CAG:709
  MG16-127 RuvC-III domain

SEQ ID NO: 3030 - protein, 150 aa, Unknown; identical to SEQ ID NO: 2925
  Description of Unknown: uncultivated organism with predicted taxonomy: Bacteroides sp. CAG:770
  MG16-128 RuvC-III domain

SEQ ID NO: 3031 - protein, 150 aa, Unknown; identical to SEQ ID NO: 2939
  Description of Unknown: uncultivated organism with predicted taxonomy: Bacteroides sp. CAG:709
  MG16-129 RuvC-III domain

SEQ ID NO: 3032 - protein, 150 aa, Unknown
  Description of Unknown: uncultivated organism with predicted taxonomy: Bacteroides sp. CAG:770
  MG16-130 RuvC-III domain
VQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKK

SEQ ID NO: 3033 - protein, 150 aa, Unknown
  Description of Unknown: uncultivated organism with predicted taxonomy: Bacteroides sp. CAG:709
  MG16-131 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSMQEVSDKVGGILVSFKAGKK

SEQ ID NO: 3034 - protein, 150 aa, Unknown; identical to SEQ ID NO: 2925
  Description of Unknown: uncultivated organism with predicted taxonomy: Bacteroides
  MG16-132 RuvC-III domain

SEQ ID NO: 3035 - protein, 159 aa, Unknown
  Description of Unknown: uncultivated organism with predicted taxonomy: Bacteroidales
  MG16-133 RuvC-III domain
RLSQYISKKAQELLKKSCREVIATSGSVTDLIRHTWGYDTILHELNLPCYKEAGLTTFIKEENTGQQKEVIKDWTKRLDHRHHAVDALTVACTSRSIIQHINTLHASREVMRGDVKTPRKEWENNDLLQQWIKEKMPFDRQYVLQKVASILVSMKSGKK

SEQ ID NO: 3036 - protein, 166 aa, Unknown
  Description of Unknown: uncultivated organism
  MG16-134 RuvC-III domain
GETQYISREAIKILKQCCKNVNATSGAVTAILRHLWGYDEILHQLDFERYKKAGLTKIVTWESDHGKNKHTKEQIVNWTKRIDHRHHAIDALVIACTQQGFVQRINTLNADETKDLMKKQIESSGVKFEEKKDLLNKYLASLTPFSTQTVADNVDKILVSFKAGKK

SEQ ID NO: 3037 - protein, 166 aa, Unknown
  Description of Unknown: uncultivated organism with predicted taxonomy: Porphyromonas sp. oral taxon 278
  MG16-135 RuvC-III domain
GETQYISREAIRILKQCCRYVNATSGSITATLRHLWGYDEILHQLNFERYKQAGLTKIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKK

SEQ ID NO: 3038 - protein, 162 aa, Unknown
  Description of Unknown: uncultivated organism with predicted taxonomy: Bacteroidales
  MG16-136 RuvC-III domain
RQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKM

SEQ ID NO: 3039 - protein, 159 aa, Unknown
  Description of Unknown: uncultivated organism with predicted taxonomy: Prevotella
  MG16-137 RuvC-III domain
RLSQYISRKAQELLRMTCRDVTVTTGEITALIRHTWGYDTILHDLNFSSYKEAGLTEIVKGEDSGRTREIIKDWSKRLDHRHHAIDALAVACTSRSIVQRINTLNASREEIRGEIKAPRKEWKDSNLLQQWIKEKMPFDRQYVLHKVASILISMKAGKK

SEQ ID NO: 3040 - protein, 162 aa, Unknown
  Description of Unknown: uncultivated organism
  MG16-138 RuvC-III domain
RQSQYISKKAVEMLKQVCRNVWTTSGSVTDFIRHQWGYDNILHDLNFKRYKDAGQTEIIISDHLGQVHQEERIKNWTKRLDHRHHAIDALTIASTKQSYIQRLNHLNSSRDKMFQELEAQSKEVKEKYSLLESWMRCRPHIPVSVVSQAIDGILVSFKTGKR

SEQ ID NO: 3041 - protein, 163 aa, Unknown
  Description of Unknown: uncultivated organism with predicted taxonomy: Bacteroidales
  MG16-139 RuvC-III domain
RQSQYIAVKAVEILQQGIRRVWTSGGSVTDFLRHQWGYDEILHTLNLPRYKQVDEMTEWVHYEHAGQEHEVERIKNWTKRLDHRHHAIDALTVALTQQSMIQRLNTLEASHDEMEKQVKEANTPYKEKKSILEKWVTEQPHFEVSEVTDKVDSILVSFRAGKR

SEQ ID NO: 3042 - protein, 126 aa, Unknown
  Description of Unknown: uncultivated organism with predicted taxonomy: Fibrobacter
  MG16-140 RuvC-III domain
RQTQYIAKKALEMLKEICYNVYATSGSVTDFIRRTWGYDEILHQLNFDRYKKGGLTELREYEHKGETHTEERIQDWSKRLDHRHHAIDALVIAMTRQSIIQRLNHLNTERDAMFQEVEKQRKDWKN

SEQ ID NO: 3043 - protein, 100 aa, Unknown
  Description of Unknown: uncultivated organism with predicted taxonomy: Bacteroidales
  MG16-141 RuvC-III domain
RQSQYIAVKAVEILQQGIRQVWTSGGSVTDFLRHQWGYDEILHTLNLPRYRKVEDLTEIVHYEHAGQEHDEERIKNWSKRIDHRHHAIDALTVALTRQAY

SEQ ID NO: 3044 - protein, 163 aa, Unknown
  Description of Unknown: uncultivated organism with predicted taxonomy: Bacteroidales
  MG16-142 RuvC-III domain
RQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKR

SEQ ID NO: 3045 - protein, 162 aa, Unknown
  Description of Unknown: uncultivated organism with predicted taxonomy: Deminuibacter soli
  MG16-143 RuvC-III domain
RQSQYIAKKAVDMLKQVCRNVWTTSGSVTDFLRHNWGYDQILHDLNLPRYKEGGMTEMVHYEHNGQEHDEERIIGWTKRLDHRHHAIDALTIASTRQSYIQRLNTLYASRDAMHAEIKKQSAHWQEKHSLLEEWTKQRPHLPVSVVRDSVDGILVSFKPGKR

SEQ ID NO: 3046 - protein, 166 aa, Unknown
  Description of Unknown: uncultivated organism with predicted taxonomy: Bacteroidales
  MG16-144 RuvC-III domain
GETQYISRESIRILKQCCRNVNATSGSITATLRHLWGYDEVLHQLNFERFKNAGLTETVTWESNHGKNKHSKEQIIDWSKRVDHRHHAIDALVVACTQQGFIQRINTLNADETKDLMKRQIETVGVKYDEKKILLDKYLTSLAPFKTQTVANAASNILVSFKPGKK

SEQ ID NO: 3047 - protein, 166 aa, Unknown
  Description of Unknown: uncultivated organism with predicted taxonomy: Bacteroides
  MG16-145 RuvC-III domain
RETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKR

SEQ ID NO: 3048 - protein, 162 aa, Unknown
  Description of Unknown: uncultivated organism with predicted taxonomy: Bacteroidetes
  MG16-146 RuvC-III domain
RQSQYISKKAVEMLKQVCRNVWTTSGSVTDFVRHHWGYDNIIHDLNFQRNKNAGQTAIITYEHRGQTHQEERIKEWSKRLDHRHHAIDALTIASTKQSYIQRLNHLNTSRDAMFQELEAQSEEFKEKYSLLERWIKERPHIPVSEVTEAVDGILVSFKAGKR

SEQ ID NO: 3049 - protein, 163 aa, Unknown
  Description of Unknown: uncultivated organism with predicted taxonomy: Bacteroidales
  MG16-147 RuvC-III domain
RQSQYIAVKAVEVLQDGIRHVWTSGGSVTDFLRHQWGYDEILHTLNLPRYRQVEGLTEYVEFEHAGQKHTEERIKNWSKRIDHRHHAIDALTVALTQQGYIQRLNTLEASHDLMEKQVKEAGTHYNEKKSILEKWINEQPHFSVEDVTNVVKGILVSFRAGKR

SEQ ID NO: 3050 - protein, 163 aa, Unknown
  Description of Unknown: uncultivated organism with predicted taxonomy: Bacteroidales
  MG16-148 RuvC-III domain
RQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEDVTNAVDGILVSFRAGKR

SEQ ID NO: 3051 - protein, 166 aa, Unknown
  Description of Unknown: uncultivated organism with predicted taxonomy: Bacteroidetes
  MG16-149 RuvC-III domain
GETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKK

SEQ ID NO: 3052 - protein, 159 aa, Unknown
  Description of Unknown: uncultivated organism with predicted taxonomy: Bacteroidales
  MG16-150 RuvC-III domain
RLSQYISRKAMEILRMGCREVVATSGSITELIRHTWGYDTILHELNCPDYKEAGLTEIIIDEKTKRQREVISDWTKRLDHRHHAIDALAVACTTHSIVQHINTLHASRKIMRDEIKTSRKEWKDNYLLQQWIKEKMPFDRHYVLHKIASILVSMKAGKK

SEQ ID NO: 3053 - protein, 166 aa, Unknown; identical to SEQ ID NO: 3047
  Description of Unknown: uncultivated organism with predicted taxonomy: Prevotella
  MG16-151 RuvC-III domain

SEQ ID NO: 3054 - protein, 162 aa, Unknown
  Description of Unknown: uncultivated organism with predicted taxonomy: Fibrobacter
  MG16-152 RuvC-III domain
RQTQYISKKALEMLKEVCRNVYATSGSVTDFIRHTWGYDEILHQLNFDRYKQGGLTEAREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKR

SEQ ID NO: 3055 - protein, 163 aa, Unknown
  Description of Unknown: uncultivated organism with predicted taxonomy: Bacteroidales
  MG16-153 RuvC-III domain
RQSQYIAVKAVEILQQGIRQVWTSGGSVTDFLRHQWGYDEILHTLNLPRYRQVEDLTEMVHYEHAGQEHDEERIKNWSKRIDHRHHAIDALTVALTRQAYIQRLNTLEASHDFMEKQVKEAGTQYNEKKSILEKWILEQPHFSVDDVTQSVDSILVSFRAGKR

SEQ ID NO: 3056 - protein, 163 aa, Unknown
  Description of Unknown: uncultivated organism with predicted taxonomy: Bacteroidales
  MG16-154 RuvC-III domain
RQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEEVTNAVDGILVSFRAGKR

SEQ ID NO: 3057 - protein, 162 aa, Unknown
  Description of Unknown: uncultivated organism with predicted taxonomy: Bacteroidales
  MG16-155 RuvC-III domain
RQSQYISKKAVEMLKQVCRNVWTTSGSVTDFVRHQWGYDNILHDLNFKRYKDAGQTEIIVCDQMGQVRQVERIKDWTKRLDHRHHAIDALTIASTKQSYIQRLNHLNASRDQMFQELETQSNKVREEYSLLENWMKERPHIPVSVVSQIVDGILVSFKTGKR

SEQ ID NO: 3058 - protein, 163 aa, Unknown; identical to SEQ ID NO: 3044
  Description of Unknown: uncultivated organism with predicted taxonomy: Bacteroidales
  MG16-156 RuvC-III domain

SEQ ID NO: 3059 - protein, 162 aa, Unknown
  Description of Unknown: uncultivated organism with predicted taxonomy: Fibrobacter
  MG16-157 RuvC-III domain
RQTQYIAKKALEMLKEVCYNVYATSGSVTDFIRHTWGYDEILHQLNFDRYKKGGLTELREFDHKGATHTEERIQNWSKRLDHRHHAIDALVIAMTRQSIIQRLNHLNTERDAMFQEVEKQSKEWKNDYSLLQEWLRERKHFSTDEVAQKVSDILASFKAGKR

SEQ ID NO: 3060 - protein, 162 aa, Unknown
  Description of Unknown: uncultivated organism with predicted taxonomy: Bacteroidetes
  MG16-158 RuvC-III domain
RQSQYISRKAVDMLKLVCRNVWTTSGSVTDFLRHNWGYDQILHDLNLPRYKEGGMTEVVHYEHNGQEHDEERIIGWTKRMDHRHHAIDALTIACTRQSYIQRLNTLNASRDAMHAEIEKQNAYWQEKHSLLEEWTRQRPHLPVSVVRDYVDGILVSFKPGKK

SEQ ID NO: 3061 - protein, 163 aa, Unknown
  Description of Unknown: uncultivated organism with predicted taxonomy: Bacteroidetes
  MG16-159 RuvC-III domain
RQSQYIARKSVEMLQQVCKNVYSTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTR

SEQ ID NO: 3062 - protein, 162 aa, Unknown
  Description of Unknown: uncultivated organism with predicted taxonomy: Fibrobacter
  MG16-160 RuvC-III domain
RQTQYIAKKALEMLKNVCYNVYATSGSITDFIRHIWGYDEILHQLNFERYKKGGLTEFREYDHKGETHTEERIQNWSKRLDHRHHAIDALVIAMTRQSIIQRLNHLNTERDAMFQEVEKQSKEWKNDYSMLQEWLRERKHFSTEDVAKKVSNILVSFKAGKR

SEQ ID NO: 3063 - protein, 163 aa, Unknown
  Description of Unknown: uncultivated organism with predicted taxonomy: Bacteroidales
  MG16-161 RuvC-III domain
RQSQYIAVKAVEILQQGIRKVWTSGGSVTDFLRHQWGYDEVLHTLNLPRYHKVEGMTEFVQYEHAGQTHEEERIKNWTKRVDHRHHAIDALTVALTRQAYIQRLNTLEASHDLMEKQVKDAGTLYNEKKSILEKWINEQPHFSVDEVTRQVDGILISFRAGKR

SEQ ID NO: 3064 - protein, 163 aa, Unknown
  Description of Unknown: uncultivated organism with predicted taxonomy: Prevotella
  MG16-162 RuvC-III domain
RQSQYIARKAIEMLQQICKNVYSTSGRVTDFVRHQWGYDEILHDLNFDRYKKAGLTTMVTQLQSGDEVEVERIKDWTKRLDNRHHAVDALAIACTTQGMIQRLNTLNASRDEMQAELNDKNGSIMDPNRSMLEKWVSIQPHITYAEAKNEVDKIIISQRPNTR

SEQ ID NO: 3065 - protein, 166 aa, Unknown; identical to SEQ ID NO: 3047
  Description of Unknown: uncultivated organism with predicted taxonomy: Bacteroides
  MG16-163 RuvC-III domain

SEQ ID NO: 3066 - protein, 163 aa, Unknown
  Description of Unknown: uncultivated organism with predicted taxonomy: Prevotella
  MG16-164 RuvC-III domain
RQSQYIAKKSVEILQQVCKNVYTTSGSVTDFVRHQWGYDEILHDLNFERFKKANLTTMVKQLHSGKEVEVERIKDWTKRLDNRHHAVDALAIACTTQGMIQRLNTLNASRDAMLDELNNKEQRMIDSERSMLEKWIISQPHVSCVEAKKEIDKILISLRPNTR

SEQ ID NO: 3067 - protein, 165 aa, Unknown
  Description of Unknown: uncultivated organism
  MG16-165 RuvC-III domain
RQSQYIAVKAVEILQQGIRQVWTSGGSVTDFLRHQWGYDEILHTLNLPRYRQVEDLTEIVHYEHAGQEHDEERIKNWSKRIDHRHHAIDALTVALTRQAYIKRLNSLNAEFTREEMLKEVEEANTVYNEKKSLLEKWILEQPHFSVDDVTNSVDSILVSFRAGKR

SEQ ID NO: 3068 - protein, 162 aa, Unknown
  Description of Unknown: uncultivated organism with predicted taxonomy: Bacteroidales
  MG16-166 RuvC-III domain
RLSQYIAKKSVEMLQQICRNVYVTSGSVTDFVRHQWGYDELLHDLNFERYKKAGLTAMVKQLHSGKEVEVERIKDWTKRLDNRHHAVDALAIACTTQGMIQRLNTLNASRDDMLEELNSKKRVADPNRSMLEKWLYAQPHVSYALAKEELDKIIVSQRPNTR

SEQ ID NO: 3069 - protein, 165 aa, Unknown
  Description of Unknown: uncultivated organism with predicted taxonomy: Bacteroidales
  MG16-167 RuvC-III domain
RLSQYIAVKAVDLLQQGIRQVWASSGTVTFFMRHQWGYDEILHTLNLPRYRRVEGMTEFVDFEHAGQKHTEERIKNWSKRIDHRHHAIDALTIALTRQAYIQSLNTLSSEITREEMIEIIKETGKVYKEKTSLLDKWARELPHFSVEDVTNAVDGILVSFRAGKR

SEQ ID NO: 3070 - protein, 159 aa, Unknown
  Description of Unknown: uncultivated organism with predicted taxonomy: Barnesiella viscericola
  MG16-168 RuvC-III domain
RLSQYISRKAQELLRTACRDVIATSGSITDLIRHTWGYDTILHELNFDCYKKAGLTEFIKDEKTGKNREVIQDWTKRLDHRHHAIDALAVACTSRSIIQRINTLHASREDIRKEIKSTRKEWQENDLLQQWIKEKMPFDRKYVLHKVASILVSMKAGKK

SEQ ID NO: 3071 - protein, 163 aa, Unknown; identical to SEQ ID NO: 3044
  Description of Unknown: uncultivated organism with predicted taxonomy: Bacteroidales
  MG16-169 RuvC-III domain

SEQ ID NO: 3072 - protein, 162 aa, Unknown; identical to SEQ ID NO: 3040
  Description of Unknown: uncultivated organism
  MG16-170 RuvC-III domain

SEQ ID NO: 3073 - protein, 163 aa, Unknown; identical to SEQ ID NO: 3063
  Description of Unknown: uncultivated organism with predicted taxonomy: Bacteroidales
  MG16-171 RuvC-III domain

SEQ ID NO: 3074 - protein, 118 aa, Unknown
  Description of Unknown: uncultivated organism with predicted taxonomy: Prevotella brevis
  MG16-172 RuvC-III domain
RQSQYIAVKAVEILQQAIRQVWTSGGSVTDFLRHQWGYDEILHTLNLPRYRQVEDLTEIVHYEHAGQEHEEERIKNWSKRIDHRHHAIDALTVALTRQAYIQRLNSLNAEFTREEMLK

SEQ ID NO: 3075 - protein, 166 aa, Unknown; identical to SEQ ID NO: 3047
  Description of Unknown: uncultivated organism with predicted taxonomy: Bacteroides
  MG16-173 RuvC-III domain

SEQ ID NO: 3076 - protein, 163 aa, Unknown
  Description of Unknown: uncultivated organism with predicted taxonomy: Bacteroidetes
  MG16-174 RuvC-III domain
RQSQYIAVKAVEVLQDGIRQVWTSGGSVTDFLRHQWGYDEILHTLNLPRYRQVEGLTEFVDYEHAGQKHTEERIKNWTKRIDHRHHAIDALTVALTQQGYIQRLNTLEASHDFMEKQVKETGTHYNEKKSILEKWINEQPHFSVEDVTSAVDGILVSFRAGKR

SEQ ID NO: 3077 - protein, 159 aa, Unknown
  Description of Unknown: uncultivated organism with predicted taxonomy: Prevotella
  MG16-175 RuvC-III domain
RLSQYISRKAQELLRTACRDVIATSGSITDLIRHTWGYDTILHELNFDCYKKAGLTEFIKDEKTGKIREVIQDWTKRLDHRHHAIDALAVACTSRSIIQRINTLHASREDIRKEIKSTRKEWQENDLLQQWIKEKMPFDRKYVLHKVASILVSMKAGKK

SEQ ID NO: 3078 - protein, 163 aa, Unknown; identical to SEQ ID NO: 3056
  Description of Unknown: uncultivated organism with predicted taxonomy: Bacteroidales
  MG16-176 RuvC-III domain

SEQ ID NO: 3079 - protein, 163 aa, Unknown; identical to SEQ ID NO: 3055
  Description of Unknown: uncultivated organism with predicted taxonomy: Bacteroidia
  MG16-177 RuvC-III domain

SEQ ID NO: 3080 - protein, 163 aa, Unknown; identical to SEQ ID NO: 3044
  Description of Unknown: uncultivated organism with predicted taxonomy: Porphyromonas sp. oral taxon 278
  MG16-178 RuvC-III domain

SEQ ID NO: 3081 - protein, 162 aa, Unknown; identical to SEQ ID NO: 3040
  Description of Unknown: uncultivated organism
  MG16-179 RuvC-III domain

SEQ ID NO: 3082 - protein, 165 aa, Unknown
  Description of Unknown: uncultivated organism with predicted taxonomy: Bacteroidales
  MG16-180 RuvC-III domain
RQSQYIAVKAVEILQQGIRQVWTSGGSVTDCLRHQWGYDEILHTLNLPRYRQVEDLTEIVHYEHAGQEHDEERIKNWSKRIDHRHHAIDALTVALTRQAYITRLNSLNAEFTREEMLKEVEEANTVYNEKKSLLEKWVNEQPHFSVEDVTQSVDGILVSFRAGKR

SEQ ID NO: 3083 - protein, 163 aa, Unknown; identical to SEQ ID NO: 3044
  Description of Unknown: uncultivated organism with predicted taxonomy: Bacteroidales
  MG16-181 RuvC-III domain

SEQ ID NO: 3084 - protein, 163 aa, Unknown
  Description of Unknown: uncultivated organism with predicted taxonomy: Prevotella
  MG16-182 RuvC-III domain
RQSQYIARKSVEMLQQICKNVYFTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTR

SEQ ID NO: 3085 - protein, 43 aa, Unknown
  Description of Unknown: uncultivated organism with predicted taxonomy: Prevotella
  MG16-183 RuvC-III domain
RLSPYIARKSVEMLQQICKNVYSTSGSVTDFVRHQWGYDEILH

SEQ ID NO: 3086 - protein, 163 aa, Unknown
  Description of Unknown: uncultivated organism with predicted taxonomy: Bacteroidales
  MG16-184 RuvC-III domain
RQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKETGTQYNEKKSILEKWVAEQPHFPVADVTENVDGILVSFRAGKR

SEQ ID NO: 3087 - protein, 162 aa, Unknown; identical to SEQ ID NO: 3062
  Description of Unknown: uncultivated organism with predicted taxonomy: Fibrobacter
  MG16-185 RuvC-III domain

SEQ ID NO: 3088 - protein, 163 aa, Unknown; identical to SEQ ID NO: 3066
  Description of Unknown: uncultivated organism with predicted taxonomy: Prevotella
  MG16-186 RuvC-III domain

SEQ ID NO: 3089 - protein, 163 aa, Unknown
  Description of Unknown: uncultivated organism with predicted taxonomy: Bacteroidales
  MG16-187 RuvC-III domain
RQSQYIAVKAVEVLQDGIRQVWTSGGSVTDFLRHQWGYDEILHTLNLPRYHQVEGLTEFVDFEHAGQKHTEERIKNWSKRIDNRHHAIDALTVALTQQGYIQRLNTLEASHDFMEKQVKEAGTKYNEKKSILEKWINEQPHFSVEDVTNAVDGILVSFRAGKR

SEQ ID NO: 3090 - protein, 163 aa, Unknown
  Description of Unknown: uncultivated organism
  MG16-188 RuvC-III domain
RQSQYIAKKSVEMLQLVCKNVYVTSGSVTDFVRHQWGYDELLHDLNFERFKKAGLTTMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTR

SEQ ID NO: 3091 - protein, 163 aa, Unknown; identical to SEQ ID NO: 3090
  Description of Unknown: uncultivated organism
  MG16-189 RuvC-III domain

SEQ ID NO: 3092 - protein, 163 aa, Unknown
  Description of Unknown: uncultivated organism with predicted taxonomy: Prevotella ruminicola
  MG16-190 RuvC-III domain
RQSQYIAKKSVEMLQQVCKNVYTTSGSVTDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTR

SEQ ID NO: 3093 - protein, 163 aa, Unknown; identical to SEQ ID NO: 3089
  Description of Unknown: uncultivated organism with predicted taxonomy: Labilibaculum filiforme
  MG16-191 RuvC-III domain

SEQ ID NO: 3094 - protein, 163 aa, Unknown
  Description of Unknown: uncultivated organism with predicted taxonomy: Bacteroidales
  MG16-192 RuvC-III domain
RQSQYIAKKSVEILLQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTR

SEQ ID NO: 3095 - protein, 162 aa, Unknown
  Description of Unknown: uncultivated organism
  MG16-193 RuvC-III domain
RQTQYIAKKAIEMLKDICYNVYATSGSVTDFIRHTWGYDEILHQLNFDRYKKGGLTELREYDHKGETHTEERIQNWSKRLDHRHHAIDALVIAMTRQSIIQRLNHLNTERDAMFQEVEKQSKEWKNDYSMLQEWLRERKHFPTEDVAKKVSDILVSFKAGKR

SEQ ID NO: 3096 - protein, 47 aa, Unknown
  Description of Unknown: uncultivated organism with predicted taxonomy: Sediminibacterium sp. C3
  MG16-194 RuvC-III domain
RLSQYIAKKSVEMLQQVCRNVYSTSGSVTDFVRHQWGYDELLHDLNF

SEQ ID NO: 3097 - protein, 161 aa, Unknown
  Description of Unknown: uncultivated organism with predicted taxonomy: Bacteroides
  MG16-195 RuvC-III domain
RLSQYISKKAMEILSFGCRDVVATSGSITAIIRHAWGWDTILEELNIQTYRNANLTEVIEVKSKGQNKKMETIKNWTKRLDNRHHAIDALVVACTSSSIIQRINTLNASKQKMRDEITSARKKWDENNILTQWIREKNPLNRKEVLEHVSSIFISMKAGKK

SEQ ID NO: 3098 - protein, 163 aa, Unknown; identical to SEQ ID NO: 3094
  Description of Unknown: uncultivated organism with predicted taxonomy: Gammaproteobacteria bacterium
  MG16-196 RuvC-III domain

SEQ ID NO: 3099 - protein, 159 aa, Unknown
  Description of Unknown: uncultivated organism with predicted taxonomy: Bacteroides
  MG16-197 RuvC-III domain
RLSQYISKKAQEILKTACREVVATSGTITDLIRHTWGYDTILHELNFPNYKEAGLTSFVTDEKTNQQREVIKDWSKRLDHRHHAVDALAVACTSRSIVQHINTLHASRDEMRKEVNSARKDWKDNNLLQQWIMEKKPFDRQYVLHKVASILVSMKAGKR

SEQ ID NO: 3100 - protein, 105 aa, Unknown
  Description of Unknown: uncultivated organism with predicted taxonomy: Bacteroidales
  MG16-198 RuvC-III domain
RQSQYIAKKSVDMLQQVCKNVYTTSGSVTDFVRHQWGYDELLHELNFERFKKAGLTAMVKQLHSGKEIEVERIKDWTKRLDNRHHAVDALAIACTTQGMIQRLNT

SEQ ID NO: 3101 - protein, 163 aa, Unknown
  Description of Unknown: uncultivated organism with predicted taxonomy: Gammaproteobacteria bacterium
  MG16-199 RuvC-III domain
RQSQYIAKKSVDMLQQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTR

SEQ ID NO: 3102 - protein, 162 aa, Unknown
  Description of Unknown: uncultivated organism with predicted taxonomy: Fibrobacter
  MG16-200 RuvC-III domain
RQTQYIAKKALEMLKDVCYNVYATSGSVTDFIRHTWGYDEILHQLNFDRYKKGGLTELREYDHKGETHTEERIQDWSKRLDHRHHAIDALVIAMTRQSIIQRLNHLNTERDAMFQEVEKQSKEWKNDYSMLQEWLRERKHFSTEDVAKKVSDILVSFKAGKR

SEQ ID NO: 3103 - protein, 166 aa, Unknown
  Description of Unknown: uncultivated organism with predicted taxonomy: Prevotella
  MG16-201 RuvC-III domain
GETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIEASGIKYEEKKVLLDKYLTSLIPFKTQIVADAVNKILVSFKAGKK

SEQ ID NO: 3104 - protein, 163 aa, Unknown
  Description of Unknown: uncultivated organism
  MG16-202 RuvC-III domain
RQSQYIAKKAVEILKDGIREVWTSGGSVTDFLRHQWGYDEILHTLNLPRYQQVEGLTETIQYEHAGQTHEEERIKNWTKRIDHRHHAIDALTVALTQQAYIQRLNTLEASHDHMQKVVNEAGTQYNEKKSLLEKWVAEQPHFSVADVTDKVDGILVSFRAGKR

SEQ ID NO: 3105 - protein, 159 aa, Unknown
  Description of Unknown: uncultivated organism with predicted taxonomy: Bacteroides sp. CAG:144
  MG16-203 RuvC-III domain
RLSQYITKKAHELLRTACRDVLATSGSITDLTRHVWGYDTILHELNLPRYKSAGITEVITDERTGREQEVIRDWNKRLDHRHHAIDALAVACTSRSMIQRINTLHASREEMREEVSSPRKDWKENDLLRQWIKEQRPFERQYVLHKVESILVSMKAGKK

SEQ ID NO: 3106 - protein, 163 aa, Unknown
  Description of Unknown: uncultivated organism with predicted taxonomy: Bacteroidales
  MG16-204 RuvC-III domain
RQSQYIAKKSVEMLQLVCKNVYTTSGSVTDFVRHQWGYDELLHELNFERFKKAGLTAMVKQMHSGKEIEVERIKDWTKRLDNRHHAVDALAIACTTQGMIQRLNTLNASREEMLEELSINDQRLIDPERSMLEKWLFVQPHISYAEAKNEINKIVISQRPNTR

SEQ ID NO: 3107 - protein, 162 aa, Unknown; identical to SEQ ID NO: 3102
  Description of Unknown: uncultivated organism with predicted taxonomy: Fibrobacter
  MG16-205 RuvC-III domain

SEQ ID NO: 3108 - protein, 163 aa, Unknown
  Description of Unknown: uncultivated organism with predicted taxonomy: Gammaproteobacteria bacterium
  MG16-206 RuvC-III domain
RQSQYIAKKSVEILQQVCKDVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTR

SEQ ID NO: 3109 - protein, 159 aa, Unknown
  Description of Unknown: uncultivated organism
  MG16-207 RuvC-III domain
RLSQYITKKAHELLRTACRDVLATSGSITDLTRHVWGYDTILHELNLPRYKSAGITEVITDERTGREQEVIKDWNKRLDHRHHAIDALAVACTSRSMIQRINTLHASREEMREEVSSPRRDWKENDLLRQWIKEQLPFERQYVLHKVESILVSMKAGKK

SEQ ID NO: 3110 - protein, 163 aa, Unknown
  Description of Unknown: uncultivated organism
  MG16-208 RuvC-III domain
RQSQMIARKSFEVLRQICHNVYATSGSVTDFLRHQWGYDNILHDLNFERFSKSDNIEEITIVGRDGIETKVKRIKGWNKRIDNRHHAVDALTIALTTQSMIQRLNTLYASRDAMHGDIEASKQKFNEKKSILEKWTAIQPHFTYSQASEAISRILISQRGGKR

SEQ ID NO: 3111 - protein, 166 aa, Unknown; identical to SEQ ID NO: 3103
  Description of Unknown: uncultivated organism with predicted taxonomy: Chryseobacterium vrystaatense
  MG16-209 RuvC-III domain

SEQ ID NO: 3112 - protein, 162 aa, Unknown
  Description of Unknown: uncultivated organism
  MG16-210 RuvC-III domain
RQSQYISKKAIEMLKQICRYVWATSGSVTDFIRHNWGYDKILHDLNFERYKSGGLTEMVHYDHQGQEHDEERIKEWTKRLDHRHHALDALTIASTQQGYIQRLNHLNTERDQMFAELEMQREEYKGRYSLLEEWIKERPHISVEDAKVAVDQIAVSFKAGKK

SEQ ID NO: 3113 - protein, 166 aa, Unknown
  Description of Unknown: uncultivated organism with predicted taxonomy: Prevotella
  MG16-211 RuvC-III domain
GETQYISRESIRILKQCCRTVNATSGKITAILRHLWGYDEILHQLNFERYKKAGLTETKTWESNHGKNKHSKEQIVDWSKRIDHRHHAIDALVVACTQQGVIQRINTLNADETKDLMKKQIESANIKYEEKKVLLDKYLTSLVPFNTKTVAEAVNKILVSFKAGKK

SEQ ID NO: 3114 - protein, 163 aa, Unknown; identical to SEQ ID NO: 3064
  Description of Unknown: uncultivated organism with predicted taxonomy: Prevotella ihumii
  MG16-212 RuvC-III domain

SEQ ID NO: 3115 - protein, 162 aa, Unknown
  Description of Unknown: uncultivated organism with predicted taxonomy: Treponema pedis
  MG16-213 RuvC-III domain
RQSQYISKKAVEMLKQVCRYVWTTSGSVTDFLRQTWGYNNILHDLNFERYKSGGLTEIRQYDHKGQEQSKECIIGWTKRLDHRHHALDALTIASTQQGYIQRLNHLNTERDEMFAELKKQSEEHKEKHSLLEDWMKERPHLSVEAVKEAVDQIAVSFKAGKK

SEQ ID NO: 3116 - protein, 163 aa, Unknown
  Description of Unknown: uncultivated organism with predicted taxonomy: Sediminibacterium sp. C3
  MG16-214 RuvC-III domain
RQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWIVVQPHISYSEAKNEIDKIVISQRPNTR

SEQ ID NO: 3117 - protein, 163 aa, Unknown
  Description of Unknown: uncultivated organism with predicted taxonomy: Prevotella
  MG16-215 RuvC-III domain
RQSQYIAKKSVEMLQQVCKNVYTTSGSVTDFVRHQWGYDDLLHDLNFERFKKAGLTAMVKQLHSGKEVEMERIKDWTKRLDNRHHAVDALAIACTTQGMIQRLNTLNASRDEILEELNSKDQRVVDPERSMLEKWVYAQPHISYAEAKNEIDKIVISQRPNTR

SEQ ID NO: 3118 - protein, 163 aa, Unknown
  Description of Unknown: uncultivated organism with predicted taxonomy: Bacteroidales
  MG16-216 RuvC-III domain
RQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLSACRNEMLDELNSKDERVIDPERSMLEKWINSQPHICYAQAKDEVDKIIVSQRPNTR

SEQ ID NO: 3119 - protein, 163 aa, Unknown
  Description of Unknown: uncultivated organism with predicted taxonomy: Porphyromonas catoniae
  MG16-217 RuvC-III domain
RQSQYIAKKSVEMLQQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTR

SEQ ID NO: 3120 - protein, 163 aa, Unknown
  Description of Unknown: uncultivated organism with predicted taxonomy: Prevotella
  MG16-218 RuvC-III domain
RQSQYIAKKSVEMLQQVCKNVYTTSGSITDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTR

SEQ ID NO: 3121 - protein, 162 aa, Unknown
  Description of Unknown: uncultivated organism with predicted taxonomy: Fibrobacter
  MG16-219 RuvC-III domain
RQTQYISKKALEMLKEVCCKVYATNGSVTDFIRHTWGYDEILHQLNFDRYKQGGLTEVREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKR

SEQ ID NO: 3122 - protein, 163 aa, Unknown
  Description of Unknown: uncultivated organism with predicted taxonomy: Sediminibacterium sp. C3
  MG16-220 RuvC-III domain
RQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLNACRNEMLDELNSKDERVIDPERSMLEKWINSQPHICYAQAKDEVDKIIVSQRPNTR

SEQ ID NO: 3123 - protein, 163 aa, Unknown
  Description of Unknown: uncultivated organism with predicted taxonomy: Sediminibacterium sp. C3
  MG16-221 RuvC-III domain
RQSQYIAKKSVEMLQQVCKNVYTTSGSVTDFVRHQWGYDEILHDLNFERFKKAGLTAMVKQLHSGKEVEVERIMDWTKRLDNRHHAVDALTIACTTQGMIQRLNTLNASRDEMLEELNSKDQRVVDPERSMLEKWIFVQPHISYVEAKNEIDKIVISQRPNTR

SEQ ID NO: 3124 - protein, 163 aa, Unknown
  Description of Unknown: uncultivated organism with predicted taxonomy: Prevotella sp. ne3005
  MG16-222 RuvC-III domain
RQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWVFVQPHISYSEAKNEIDKIVISQRPNTR

SEQ ID NO: 3125 - protein, 163 aa, Unknown
  Description of Unknown: uncultivated organism with predicted taxonomy: Prevotella copri
  MG16-223 RuvC-III domain
RQSQYIAKKSVEILQQVCKNVYTTSGSVTDFVRHQWGYDEILHDLNFEHFKKANLTTMVKQLHSGKEVEVERIKDWTKRLDNRHHAVDALAIACTTQGMIQRLNTLNASRDAMLDELNNKEQRMIDSERSMLEKWIISQPHVSYAEAKKEIDKILISLRPNTR

SEQ ID NO: 3126 - protein, 135 aa, Unknown
  Description of Unknown: uncultivated organism with predicted taxonomy: Bacteroides sp. CAG:770
  MG16-224 RuvC-III domain
RQSQYIAKKSVEMLQQVCKNVYTTSGSVTDFVRHQWGYDELLHELNIERFKKAGLTAMVKQLHSGKEVEVERIKDWTKRLDNRHHAVDAFAIACTTQGMIQRLNTLNASRDEMFEELNTKDQRLIDPERSMLEKW

SEQ ID NO: 3127 - protein, 162 aa, Unknown
  Description of Unknown: uncultivated organism with predicted taxonomy: Bacteroidales
  MG16-225 RuvC-III domain
RQSQYISKKAVEILRSAIRDVYATSGSVTDFLRHIWGYDQILHNLNLPKYRDAELTEFVTYDHRGQEHQEERIKNWSKRIDHRHHAIDALTIALTRQGYIQRLNNLNASHDDIAEAVRKVNPLMEKKYSLLEKYIYIQPHFTVQEVTDKVDGILVSFRAGKK

SEQ ID NO: 3128 - protein, 20 aa, Unknown
  Description of Unknown: uncultivated organism
  MG16-226 RuvC-III domain
RLSQYIATKAVEILQQGIRQ

SEQ ID NO: 3129 - protein, 165 aa, Unknown
  Description of Unknown: uncultivated organism with predicted taxonomy: Bacteroidales
  MG16-228 RuvC-III domain
RQSQYIAKKAAEILRQGYRNVYATSGSVTDFLRHQWGYDEILHRLNLPRYQQVEGLTELVTYDHCGQEHQQERIKGWTKRLDHRHHAIDALTIALTQQSVIQRLNTLNTSREQMFDDLGKRTDTPEYTEKRSLLENWIDAQPHFSVQEVTDKVDGILVSFRAGKR

SEQ ID NO: 3130 - protein, 165 aa, Unknown; identical to SEQ ID NO: 3129
  Description of Unknown: uncultivated organism with predicted taxonomy: Bacteroidales
  MG16-229 RuvC-III domain

SEQ ID NO: 3131 - protein, 150 aa, Unknown
  Description of Unknown: uncultivated organism with predicted taxonomy: Bacteroides sp. CAG:545
  MG16-230 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEASDNVSRILVSFKAGKK

SEQ ID NO: 3132 - protein, 150 aa, Unknown
  Description of Unknown: uncultivated organism with predicted taxonomy: Bacteroides sp. CAG:770
  MG16-231 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNILNAKTAIGEEQMSLDKWTLAQAHFSVADVADHVADILVSFKSGKR

SEQ ID NO: 3133 - protein, 150 aa, Unknown
  Description of Unknown: uncultivated organism with predicted taxonomy: Bacteroides sp. CAG:770
  MG16-232 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLSQPHFSVQEVSDNVSRILVSFKAGKK

SEQ ID NO: 3134 - protein, 150 aa, Unknown; identical to SEQ ID NO: 2934
  Description of Unknown: uncultivated organism with predicted taxonomy: Bacteroides sp. CAG:545
  MG16-233 RuvC-III domain

SEQ ID NO: 3135 - protein, 150 aa, Unknown
  Description of Unknown: uncultivated organism with predicted taxonomy: Bacteroides sp. CAG:770
  MG16-234 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKR

SEQ ID NO: 3136 - protein, 150 aa, Unknown; identical to SEQ ID NO: 3135
  Description of Unknown: uncultivated organism with predicted taxonomy: Bacteroides sp. CAG:770
  MG16-235 RuvC-III domain

SEQ ID NO: 3137 - protein, 150 aa, Unknown
  Description of Unknown: uncultivated organism with predicted taxonomy: Bacteroides sp. CAG:770
  MG16-236 RuvC-III domain
VQTQYISRKAMEILNQVCRNVYGSSGDVTASLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKK

SEQ ID NO: 3138 - protein, 150 aa, Unknown; identical to SEQ ID NO: 2925
  Description of Unknown: uncultivated organism with predicted taxonomy: Bacteroides sp. CAG:770
  MG16-237 RuvC-III domain

SEQ ID NO: 3139 - protein, 150 aa, Unknown; identical to SEQ ID NO: 2925
  Description of Unknown: uncultivated organism with predicted taxonomy: Bacteroides sp. CAG:545
  MG16-238 RuvC-III domain

SEQ ID NO: 3140 - protein, 150 aa, Unknown; identical to SEQ ID NO: 2939
  Description of Unknown: uncultivated organism with predicted taxonomy: Bacteroides sp. CAG:770
  MG16-239 RuvC-III domain

SEQ ID NO: 3141 - protein, 150 aa, Unknown; identical to SEQ ID NO: 2939
  Description of Unknown: uncultivated organism with predicted taxonomy: Bacteroides sp. CAG:709
  MG16-240 RuvC-III domain

SEQ ID NO: 3142 - protein, 150 aa, Unknown; identical to SEQ ID NO: 2939
  Description of Unknown: uncultivated organism with predicted taxonomy: Bacteroides sp. CAG:770
  MG16-242 RuvC-III domain

SEQ ID NO: 3143 - protein, 150 aa, Unknown; identical to SEQ ID NO: 2939
  Description of Unknown: uncultivated organism with predicted taxonomy: Bacteroides sp. CAG:709
  MG16-243 RuvC-III domain

SEQ ID NO: 3144 - protein, 163 aa, Unknown
  Description of Unknown: uncultivated organism with predicted taxonomy: Bacteroidales
  MG16-245 RuvC-III domain
RQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSILERWVADQPHFSVADVTNKVDGILVSFRAGKR

SEQ ID NO: 3145 - protein, 163 aa, Unknown
  Description of Unknown: uncultivated organism with predicted taxonomy: Bacteroides sp. CAG:770
  MG16-246 RuvC-III domain
RQSQYIARKSVEMLQQVCKDVYTTSGSVTDFVRHQWGYDEILHDLNFERFKKAGLTTMVTQLHSGKEVEVERIKDWTKRLDNRHHAVDALAIACTTQGMIQRLNTLNASREGILDELNSKEERVVDPERSMLEKWIYTQPHISYAQAKEAIDNIIISQRPNIR

SEQ ID NO: 3146 - protein, 163 aa, Unknown
  Description of Unknown: uncultivated organism with predicted taxonomy: Porphyromonas sp. oral taxon 278
  MG16-247 RuvC-III domain
RQSQYIAVKAVEILQTGVRRVWTSGGSVTDFLRHQWGYDEILHTLNLPRYRQVEALTEIVHYEHAGQEHNEERIKNWTKRTDHRHHAIDALTVALTQQSYIQRLNTLEASHDWMEKQVKEANTPYNEKKSVLERWVADQPHFSVAEVTDKVDGILVSFRAGKR

SEQ ID NO: 3147 - protein, 163 aa, Unknown
  Description of Unknown: uncultivated organism with predicted taxonomy: Coprobacter sp.
  MG16-248 RuvC-III domain
RQSQYIAVKAVEILQAGIRHVWTSGGSVTDFLRHQWGYDEILHTLNLPRYRKVDELTEIVHFEHAGQEHEEERIKNWTKRIDHRHHAIDALTVALTQQSYIQRLNTLEASHDWMEKQVKEVNTPYNEKKSVLERWIADQPHFSVSDVTDKVDGILVSFRAGKR

SEQ ID NO: 3148 - protein, 162 aa, Unknown; identical to SEQ ID NO: 3057
  Description of Unknown: uncultivated organism with predicted taxonomy: Bacteroides sp. CAG:144
  MG16-249 RuvC-III domain

SEQ ID NO: 3149 - protein, 163 aa, Unknown
  Description of Unknown: uncultivated organism with predicted taxonomy: Sediminibacterium sp. C3
  MG16-250 RuvC-III domain
RQSQYIAKKSVEMLQQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDVMLEELSSNDQRLVDPERSMLEKWIYVQPHISYAEAKNEVDKIVISQRPNTR

SEQ ID NO: 3150 - protein, 159 aa, Unknown
  Description of Unknown: uncultivated organism with predicted taxonomy: Bacteroides sp. CAG:144
  MG16-251 RuvC-III domain
RLSQYISKKSQELLKMACRNVVATSGNITDLVRHTWGYDTILHELNFPCYKEAGLTTFIKDENTGQQREVIKDWTKRLDHRHHAIDALAVACTSRSIVQRINTLHASREEMREDVKSPRKDWEDNDLLQQWIKEKMPFDRDYVLHKVASILVSMKAGKK

SEQ ID NO: 3151 - protein, 162 aa, Unknown
  Description of Unknown: uncultivated organism with predicted taxonomy: Bacteroidales
  MG16-252 RuvC-III domain
RQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKK

SEQ ID NO: 3152 - protein, 159 aa, Unknown
  Description of Unknown: uncultivated organism
  MG16-253 RuvC-III domain
RLSQYISKKAQELLKAACREVMATSGSITDLIRHTWGYDTILHELNFPRYKDAGLTEIIKDEETGMQREVIPDWSKRLDHRHHAIDALAVACTSRSIVQRINTLNASREIIREEIKTSRKEWEDNDLLQQWIKEKMPFDRQYVVQKVASILVSMKAGKK

SEQ ID NO: 3153 - protein, 163 aa, Unknown
  Description of Unknown: uncultivated organism with predicted taxonomy: Marinilabiliaceae
  MG16-254 RuvC-III domain
RQSQYIAVKAVEVLQDGIRQVWTSGGSVTDFLRHQWGYDEILHTLNLPRYRQVEGLTELVDFEHAGQKHTEERIKNWSKRIDHRHHAIDALTVALTQQGYIQRLNTLEASHDFMEKQVKEAGTKYNEKKSILEKWINEQPHFSVEEVTNAVDRILVSFRAGKR

SEQ ID NO: 3154 - protein, 163 aa, Unknown
  Description of Unknown: uncultivated organism with predicted taxonomy: Bacteroidetes
  MG16-255 RuvC-III domain
RLSQNIARSAMELLRQVCHNVYATSGSVTDFVRHQWGYDNILHDLNFSRFAKSGNTEFITVVGADGKETQQERIKGWSKRMDNRHHAVDALAIALTTQSMIQRINNLNASREFMQKDVEASKEKFKEKKSLLEKWVAIQPHLSYGQAKDAISGILVSQRSGKH

SEQ ID NO: 3155 - protein, 159 aa, Unknown; identical to SEQ ID NO: 3150
  Description of Unknown: uncultivated organism with predicted taxonomy: Bacteroides sp. CAG:144
  MG16-256 RuvC-III domain

SEQ ID NO: 3156 - protein, 165 aa, Unknown
  Description of Unknown: uncultivated organism with predicted taxonomy: Bacteroidia
  MG16-257 RuvC-III domain
RQSQYIAVKAVEILQQGIRQVWTSGGSVTDFLRHLWGYDEILHTLNLPRYRQVEELTEIVHYEHAGQEHDEERIKNWSKRIDHRHHAIDALTVALTRQAYIQRLNSLNAEFTREEMLKEVEEANTVYNEKKSLLEKWVNEQPHFSVDDVTQSVDSILVSFRAGKR

SEQ ID NO: 3157 - protein, 163 aa, Unknown; identical to SEQ ID NO: 3146
  Description of Unknown: uncultivated organism with predicted taxonomy: Bacteroidales
  MG16-258 RuvC-III domain

SEQ ID NO: 3158 - protein, 162 aa, Unknown
  Description of Unknown: uncultivated organism with predicted taxonomy: Prevotella saccharolytica
  MG16-259 RuvC-III domain
RQTQYIAKKALEMLKDVCYNVYATSGSVTDFIRHTWGYDEILHQLNYDRYKKGGLTEFREYDHKGETHTEERIQDWSKRLDHRHHAIDALVIAMTRQSIIQRLNHLNTERDAMFQEVEKQRKEWKNDYSMLQEWLRERKHFSAEDVAKKVSDILVSFKAGKR

SEQ ID NO: 3159 - protein, 163 aa, Unknown; identical to SEQ ID NO: 3154
  Description of Unknown: uncultivated organism with predicted taxonomy: Bacteroides sp. CAG:770
  MG16-260 RuvC-III domain

SEQ ID NO: 3160 - protein, 162 aa, Unknown
  Description of Unknown: uncultivated organism with predicted taxonomy: Bacteroidales
  MG16-261 RuvC-III domain
RQTQYISKKALELLREICHNVYATSGSVTDFIRHTWGYDEILHQLNFDRYKQSGLTEIREFDNKGEIHKEERIQKWNKRLDHRHHAIDALVIAMTKQSIIQRLNHLNTERDAMFQEVEKQSIEWKNDFSLLQEWLRERKHFSTKDVANRVANILISFKAGKR

SEQ ID NO: 3161 - protein, 120 aa, Unknown
  Description of Unknown: uncultivated organism with predicted taxonomy: Porphyromonas catoniae
  MG16-262 RuvC-III domain
RQSQYIAKKSVEMLLQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDEMLEELNGK

SEQ ID NO: 3162 - protein, 163 aa, Unknown
  Description of Unknown: uncultivated organism with predicted taxonomy: Sediminibacterium sp. C3
  MG16-263 RuvC-III domain
RLSQYIAKKSVEMLQQVCRNVYSTSGSVTDFVRHQWGYDELLHDLNFERYKRAGLTAMVTQLRSGKEVEVERIKDWTKRLDNRHHAVDALAIACTTQGMIQRLNTLNASREDILDELNKTEERNDDSERSMLEKWICSQPHISYAEAKDELDKIIISQRPSTR

SEQ ID NO: 3163 - protein, 166 aa, Unknown
  Description of Unknown: uncultivated organism
  MG16-264 RuvC-III domain
GETQYISRESIRILKQCCRNVNATSGTVTATLRHLWGYDEILHQLNFERYKQAGLTETVTWTSNHGKNEHSKEQIVDWSKRIDHRHHAIDALVVACTQQGFIQRINTLNADDTKDLMRKQIESAGIKFEEKKVLLDKYLASFVPFTTKVVADEVNKILVSFKAGKK

SEQ ID NO: 3164 - protein, 163 aa, Unknown
  Description of Unknown: uncultivated organism
  MG16-265 RuvC-III domain
RQSQYIAKKSVEMLQLVCRNVYTTSGSVTETVRRLWGYNELLHDLNFERFKKAGLTTMVTQLHSGEEIEVERIKDWTKRLDNRHHAVDALAIACTTQGMIQRLNTLNASRDDMLKELNSQEQRVVDPEHSMLEKWIYTQPHISYVQAKEAIEKIIISQRPNTR

SEQ ID NO: 3165 - protein, 162 aa, Unknown; identical to SEQ ID NO: 3095
  Description of Unknown: uncultivated organism with predicted taxonomy: Porphyromonas sp. oral taxon 278
  MG16-266 RuvC-III domain

SEQ ID NO: 3166 - protein, 163 aa, Unknown
  Description of Unknown: uncultivated organism
  MG16-267 RuvC-III domain
RQSQYIAKKSVEMLLQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTR

SEQ ID NO: 3167 - protein, 163 aa, Unknown
  Description of Unknown: uncultivated organism with predicted taxonomy: Prevotella
  MG16-268 RuvC-III domain
SLSQYISRKAMEILQTGCRKVYATSGSITDIERHLWGYDTILHELNFPRYKCAGLTTVIKEEYEEGIITEKEVITNWSKRKDNRHHAIDALVIACTTQDTIQRINTLHASRDELQKETSGNPVFYSEKSTLLERWIKGKQPIPRHEVLEQVKQIAISIKAGKK

SEQ ID NO: 3168 - protein, 163 aa, Unknown; identical to SEQ ID NO: 3118
  Description of Unknown: uncultivated organism with predicted taxonomy: Bacteroidales
  MG16-269 RuvC-III domain

SEQ ID NO: 3169 - protein, 163 aa, Unknown
  Description of Unknown: uncultivated organism with predicted taxonomy: Bacteroidales
  MG16-270 RuvC-III domain
RQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSVLERWVADQPHFSVADVTDKVDGILVSFRAGKR

SEQ ID NO: 3170 - protein, 164 aa, Unknown
  Description of Unknown: uncultivated organism with predicted taxonomy: Bacteroidales
  MG16-271 RuvC-III domain
RQSQYIAAKAVEILQTAIRDVHATSGSVTELLRHQWGYDEILHHLNLPRYNKADLTEIVQYDHAGQKHTVERIKNWNKRLDQRHHAVDALTIALTKQSYIQRLNTLNASRETIYNEVEQADAKLRNEEKRTLLENWVAIQPHFPVKDVEDKVAGILVSFRAGKR

SEQ ID NO: 3171 - protein, 163 aa, Unknown
  Description of Unknown: uncultivated organism with predicted taxonomy: Bacteroides sp. CAG:770
  MG16-272 RuvC-III domain
RQSQYIAKKSVEMLQQVCKNVYTTSGSVTDFVRHQWGYDELLHELNFERFKKAGLTAMVKQLHSGKEIEVERIKDWTKRLDNRHHAVDALAIACTTQGMIQRLNTLNASRDEMQEELSSKEQRLVDPERSMLEKWIFAQPHISYAEAKNEIDKIIISQRPNTR

SEQ ID NO: 3172 - protein, 163 aa, Unknown
  Description of Unknown: uncultivated organism with predicted taxonomy: Bacteroidetes
  MG16-273 RuvC-III domain
RLSQYIAKKSVEMLQQVCKNVYATSGSITDFVRHQWGYDELLHDLNFERFKKAGLTTMVKQLHSGEEVEVERIANWTKRLDNRHHAVDALAIACTTQSMIQRLNTLNASRDDMLEEQNSKDQRLVDPERSMLEKWVFIQPHITYADAKKEIDKIVISQRPNTR

SEQ ID NO: 3173 - protein, 159 aa, Unknown
  Description of Unknown: uncultivated organism with predicted taxonomy: Bacteroidales
  MG16-274 RuvC-III domain
RLSQYISKKAQELLKTACREVMATSGSITDLIRHTWGYDTILHELNFPRYKDAGLTEIIKDEETGMQRELIPDWSKRLDHRHHAIDALAVACTSRSIVQRINTLHASREIIRDEIKTSRKEWEDNDLLQQWIKEKMPFDRQYVVQKVASILVSMKAGKK

SEQ ID NO: 3174 - protein, 166 aa, Unknown; identical to SEQ ID NO: 3163
  Description of Unknown: uncultivated organism with predicted taxonomy: Bacteroidetes
  MG16-275 RuvC-III domain

SEQ ID NO: 3175 - protein, 134 aa, Unknown
  Description of Unknown: uncultivated organism with predicted taxonomy: Clostridiales
  MG18-1 RuvC-III domain
VETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGR

SEQ ID NO: 3176 - protein, 136 aa, Unknown
  Description of Unknown: uncultivated organism with predicted taxonomy: Phascolarctobacterium succinatutens
  MG18-3 RuvC-III domain
VETRQSTKAVATILKTAYKHSEVVYVKAGNVSDFRHQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGK

SEQ ID NO: 3177 - protein, 136 aa, Unknown
  Description of Unknown: uncultivated organism with predicted taxonomy: Phascolarctobacterium succinatutens
  MG18-4 RuvC-III domain
VETRQSTKAVATILKTAYKHSEIVYVKAGNVSDFRQKFEFVKCRDVNDLHHAKDAYLNIVVGNCYHVKFTDKPMDFIKKNQDNRSYSLKPEIFYKFSIKRDSEIAWVGGKDGTITTVTKTMHKNNILFTRQPVEGK

SEQ ID NO: 3178 - protein, 136 aa, Unknown
  Description of Unknown: uncultivated organism with predicted taxonomy: Phascolarctobacterium succinatutens
  MG18-5 RuvC-III domain
VETRQSTKAVAAILKTAYQNSEVVYVKAGNVSDFRKQFKFVKCRDVNDLHHAKDAYLNIVVGNCYHVKFTANPLNFITKNQDNRRYSLKPEIFYKFSIKRDGEIAWIGGKDGTITTVTKTMHKNNILFTRQPVEGK

SEQ ID NO: 3179 - protein, 136 aa, Unknown
  Description of Unknown: uncultivated organism with predicted taxonomy: Phascolarctobacterium
  MG18-6 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGEDGTMAIVARTMHKNNILFTRQAVEGK

SEQ ID NO: 3180 - protein, 136 aa, Unknown
  Description of Unknown: uncultivated organism with predicted taxonomy: Acidaminococcales
  MG18-7 RuvC-III domain
VETRQSTKATADILKSAYEHSEVVYVKAGNVSDFRQQFDFVKCREVNDLHHAKDAYLNIVVGNCYHVKFTINPLMFIRGNQDNRRYSLKPEVFYAHDIKRNGEIAWLAGDNGTMATVKRVMQKNNVLFTRLAVEGK

SEQ ID NO: 3181 - protein, 136 aa, Unknown
  Description of Unknown: uncultivated organism
  MG18-8 RuvC-III domain
VETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGK

SEQ ID NO: 3182 - protein, 136 aa, Unknown
  Description of Unknown: uncultivated organism with predicted taxonomy: Phascolarctobacterium succinatutens
  MG18-9 RuvC-III domain
VETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3183 - protein, 136 aa, Unknown; identical to SEQ ID NO: 3182
  Description of Unknown: uncultivated organism with predicted taxonomy: Phascolarctobacterium
  MG18-10 RuvC-III domain

SEQ ID NO: 3184 - protein, 136 aa, Unknown
  Description of Unknown: uncultivated organism with predicted taxonomy: Phascolarctobacterium succinatutens
  MG18-11 RuvC-III domain
VETRQSTKAVAAILKIAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3185 - protein, 136 aa, Unknown
  Description of Unknown: uncultivated organism with predicted taxonomy: Phascolarctobacterium succinatutens
  MG18-12 RuvC-III domain
VETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGK

SEQ ID NO: 3186 - protein, 136 aa, Unknown; identical to SEQ ID NO: 3177
  Description of Unknown: uncultivated organism with predicted taxonomy: Phascolarctobacterium succinatutens
  MG18-13 RuvC-III domain

SEQ ID NO: 3187 - protein, 136 aa, Unknown; identical to SEQ ID NO: 3182
  Description of Unknown: uncultivated organism with predicted taxonomy: Phascolarctobacterium
  MG18-14 RuvC-III domain

SEQ ID NO: 3188 - protein, 136 aa, Unknown
  Description of Unknown: uncultivated organism with predicted taxonomy: Phascolarctobacterium succinatutens
  MG18-15 RuvC-III domain
VETRQSTKAVAAILKTAYQNSEVVYVKAGNVSDFRQQFKFEKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3189 - protein, 136 aa, Unknown; identical to SEQ ID NO: 3185
  Description of Unknown: uncultivated organism with predicted taxonomy: Phascolarctobacterium succinatutens
  MG18-16 RuvC-III domain

SEQ ID NO: 3190 - protein, 136 aa, Unknown; identical to SEQ ID NO: 3182
  Description of Unknown: uncultivated organism with predicted taxonomy: Phascolarctobacterium
  MG18-17 RuvC-III domain

SEQ ID NO: 3191 - protein, 136 aa, Unknown; identical to SEQ ID NO: 3182
  Description of Unknown: uncultivated organism with predicted taxonomy: Phascolarctobacterium succinatutens
  MG18-18 RuvC-III domain

SEQ ID NO: 3192 - protein, 136 aa, Unknown; identical to SEQ ID NO: 3182
  Description of Unknown: uncultivated organism with predicted taxonomy: Phascolarctobacterium
  MG18-19 RuvC-III domain

SEQ ID NO: 3193 - protein, 136 aa, Unknown; identical to SEQ ID NO: 3182
  Description of Unknown: uncultivated organism with predicted taxonomy: Phascolarctobacterium
  MG18-20 RuvC-III domain

SEQ ID NO: 3194 - protein, 136 aa, Unknown; identical to SEQ ID NO: 3182
  Description of Unknown: uncultivated organism with predicted taxonomy: Phascolarctobacterium
  MG18-21 RuvC-III domain

SEQ ID NO: 3195 - protein, 136 aa, Unknown; identical to SEQ ID NO: 3177
  Description of Unknown: uncultivated organism with predicted taxonomy: Phascolarctobacterium
  MG18-22 RuvC-III domain

SEQ ID NO: 3196 - protein, 136 aa, Unknown
  Description of Unknown: uncultivated organism with predicted taxonomy: Phascolarctobacterium succinatutens
  MG18-23 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVVRTMHKNNILFTRQAVEGK

SEQ ID NO: 3197 - protein, 136 aa, Unknown
  Description of Unknown: uncultivated organism with predicted taxonomy: Phascolarctobacterium
  MG18-24 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3198 - protein, 136 aa, Unknown; identical to SEQ ID NO: 3182
  Description of Unknown: uncultivated organism with predicted taxonomy: Phascolarctobacterium succinatutens
  MG18-25 RuvC-III domain

SEQ ID NO: 3199 - protein, 136 aa, Unknown; identical to SEQ ID NO: 3182
  Description of Unknown: uncultivated organism with predicted taxonomy: Phascolarctobacterium succinatutens
  MG18-26 RuvC-III domain

SEQ ID NO: 3200 - protein, 136 aa, Unknown; identical to SEQ ID NO: 3197
  Description of Unknown: uncultivated organism with predicted taxonomy: Phascolarctobacterium succinatutens
  MG18-27 RuvC-III domain

SEQ ID NO: 3201 - protein, 136 aa, Unknown
  Description of Unknown: uncultivated organism with predicted taxonomy: Phascolarctobacterium
  MG18-28 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3202 - protein, 136 aa, Unknown; identical to SEQ ID NO: 3197
  Description of Unknown: uncultivated organism with predicted taxonomy: Phascolarctobacterium succinatutens
  MG18-29 RuvC-III domain

SEQ ID NO: 3203 - protein, 136 aa, Unknown
  Description of Unknown: uncultivated organism with predicted taxonomy: Phascolarctobacterium succinatutens
  MG18-30 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGK

SEQ ID NO: 3204 - protein, 136 aa, Unknown; identical to SEQ ID NO: 3203
  Description of Unknown: uncultivated organism with predicted taxonomy: Phascolarctobacterium succinatutens
  MG18-31 RuvC-III domain

SEQ ID NO: 3205 - protein, 136 aa, Unknown
  Description of Unknown: uncultivated organism with predicted taxonomy: Phascolarctobacterium succinatutens
  MG18-32 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGK

SEQ ID NO: 3206 - protein, 136 aa, Unknown; identical to SEQ ID NO: 3182
  Description of Unknown: uncultivated organism with predicted taxonomy: Phascolarctobacterium succinatutens
  MG18-33 RuvC-III domain

SEQ ID NO: 3207 - protein, 136 aa, Unknown; identical to SEQ ID NO: 3182
  Description of Unknown: uncultivated organism with predicted taxonomy: Phascolarctobacterium succinatutens
  MG18-34 RuvC-III domain

SEQ ID NO: 3208 - protein, 136 aa, Unknown; identical to SEQ ID NO: 3185
  Description of Unknown: uncultivated organism with predicted taxonomy: Phascolarctobacterium succinatutens
  MG18-35 RuvC-III domain

SEQ ID NO: 3209 - protein, 136 aa, Unknown; identical to SEQ ID NO: 3182
  Description of Unknown: uncultivated organism with predicted taxonomy: Phascolarctobacterium succinatutens
  MG18-36 RuvC-III domain

SEQ ID NO: 3210 - protein, 136 aa, Unknown; identical to SEQ ID NO: 3197
  Description of Unknown: uncultivated organism with predicted taxonomy: Phascolarctobacterium succinatutens
  MG18-37 RuvC-III domain

SEQ ID NO: 3211 - protein, 136 aa, Unknown; identical to SEQ ID NO: 3203
  Description of Unknown: uncultivated organism with predicted taxonomy: Phascolarctobacterium
  MG18-38 RuvC-III domain

SEQ ID NO: 3212 - protein, 136 aa, Unknown; identical to SEQ ID NO: 3205
  Description of Unknown: uncultivated organism with predicted taxonomy: Phascolarctobacterium
  MG18-39 RuvC-III domain

SEQ ID NO: 3213 - protein, 136 aa, Unknown
  Description of Unknown: uncultivated organism with predicted taxonomy: Phascolarctobacterium succinatutens
  MG18-40 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGK

SEQ ID NO: 3214 - protein, 136 aa, Unknown
  Description of Unknown: uncultivated organism with predicted taxonomy: Phascolarctobacterium succinatutens
  MG18-41 RuvC-III domain
VETRQSTKAVAAILKTAYQNSEVVYVKAGNVSDFRQQFKFVKCRDVNDLHHAKDAYLNIVVGNCYHVKFTAHPLNFITKNQDNRRYSLKPEIFYKFSIKRDGEIAWLGGEDGTMATVARTMHKNNILFTRQAVEGK

SEQ ID NO: 3215 - protein, 136 aa, Unknown; identical to SEQ ID NO: 3176
  Description of Unknown: uncultivated organism with predicted taxonomy: Phascolarctobacterium succinatutens
  MG18-42 RuvC-III domain

SEQ ID NO: 3216 - protein, 136 aa, Unknown; identical to SEQ ID NO: 3185
  Description of Unknown: uncultivated organism with predicted taxonomy: Phascolarctobacterium succinatutens
  MG18-43 RuvC-III domain

SEQ ID NO: 3217 - protein, 136 aa, Unknown; identical to SEQ ID NO: 3197
  Description of Unknown: uncultivated organism with predicted taxonomy: Phascolarctobacterium succinatutens
  MG18-44 RuvC-III domain

SEQ ID NO: 3218 - protein, 136 aa, Unknown; identical to SEQ ID NO: 3197
  Description of Unknown: uncultivated organism with predicted taxonomy: Phascolarctobacterium succinatutens
  MG18-45 RuvC-III domain

SEQ ID NO: 3219 - protein, 136 aa, Unknown
  Description of Unknown: uncultivated organism with predicted taxonomy: Phascolarctobacterium
  MG18-46 RuvC-III domain
VETRQSTKAVAAILKTAYQNSEVVYVKAGNVSDFRQQFKFVKCREVNDLHHAKDAYLNIVVGNCYHVKFTANHLNFITKNQDNRRYSLKPEIFYKFSIKRDGEIAWLGGEDGTMATVARTMHKNNILFTRQAVEGK

SEQ ID NO: 3220 - protein, 136 aa, Unknown; identical to SEQ ID NO: 3180
  Description of Unknown: uncultivated organism with predicted taxonomy: Phascolarctobacterium
  MG18-47 RuvC-III domain

SEQ ID NO: 3221 - protein, 136 aa, Unknown; identical to SEQ ID NO: 3197
  Description of Unknown: uncultivated organism with predicted taxonomy: Phascolarctobacterium succinatutens
  MG18-48 RuvC-III domain

SEQ ID NO: 3222 - protein, 136 aa, Unknown; identical to SEQ ID NO: 3197
  Description of Unknown: uncultivated organism with predicted taxonomy: Phascolarctobacterium succinatutens
  MG18-49 RuvC-III domain

SEQ ID NO: 3223 - protein, 136 aa, Unknown; identical to SEQ ID NO: 3182
  Description of Unknown: uncultivated organism with predicted taxonomy: Phascolarctobacterium succinatutens
  MG18-50 RuvC-III domain

SEQ ID NO: 3224 - protein, 136 aa, Unknown
  Description of Unknown: uncultivated organism with predicted taxonomy: Phascolarctobacterium succinatutens
  MG18-51 RuvC-III domain
VETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGK

SEQ ID NO: 3225 - protein, 136 aa, Unknown; identical to SEQ ID NO: 3197
  Description of Unknown: uncultivated organism with predicted taxonomy: Phascolarctobacterium succinatutens
  MG18-52 RuvC-III domain

SEQ ID NO: 3226 - protein, 136 aa, Unknown; identical to SEQ ID NO: 3203
  Description of Unknown: uncultivated organism with predicted taxonomy: Firmicutes
  MG18-53 RuvC-III domain

SEQ ID NO: 3227 - protein, 136 aa, Unknown
  Description of Unknown: uncultivated organism with predicted taxonomy: Phascolarctobacterium
  MG18-54 RuvC-III domain
VETRQSTKAVATILKTAYKHSEIVYVKAGNVSDFRQKFEFVKCRDVNDLHHAKNAYLNIVVGNCYYVKFTAKPLDFIKKNQDNRSYSLKPEIFYKFSIKRDSEIAWVGGKDGTITTVTKTIHKNNILFTRQPVEGK

SEQ ID NO: 3228 - protein, 136 aa, Unknown; identical to SEQ ID NO: 3197
  Description of Unknown: uncultivated organism with predicted taxonomy: Phascolarctobacterium
  MG18-55 RuvC-III domain

SEQ ID NO: 3229 - protein, 136 aa, Unknown; identical to SEQ ID NO: 3182
  Description of Unknown: uncultivated organism with predicted taxonomy: Phascolarctobacterium succinatutens
  MG18-56 RuvC-III domain

SEQ ID NO: 3230 - protein, 136 aa, Unknown; identical to SEQ ID NO: 3197
  Description of Unknown: uncultivated organism with predicted taxonomy: Phascolarctobacterium succinatutens
  MG18-57 RuvC-III domain

SEQ ID NO: 3231 - protein, 136 aa, Unknown
  Description of Unknown: uncultivated organism with predicted taxonomy: Phascolarctobacterium succinatutens
  MG18-58 RuvC-III domain
VETRQSTKAVAAILKTAYQNSEVVYVKAGNVSDFRQQFKFVKCREVNDLHHAKDAYLNIVVGNCHHVKFTANPLNFITKNQDNRRYSLKPEIFYKFSIKRDGEIAWLGGEDGTMATVARTMHKNNILFTRQAVEGK

SEQ ID NO: 3232 - protein, 136 aa, Unknown; identical to SEQ ID NO: 3203
  Description of Unknown: uncultivated organism with predicted taxonomy: Phascolarctobacterium succinatutens
  MG18-59 RuvC-III domain

SEQ ID NO: 3233 - protein, 136 aa, Unknown; identical to SEQ ID NO: 3197
  Description of Unknown: uncultivated organism
  MG18-60 RuvC-III domain

SEQ ID NO: 3234 - protein, 136 aa, Unknown
  Description of Unknown: uncultivated organism with predicted taxonomy: Phascolarctobacterium succinatutens
  MG18-61 RuvC-III domain
VETRQSTKAVAAILKTAYQNSEVVYVKAGNVSDFRQQFKFVKCRELNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3235 - protein, 136 aa, Unknown; identical to SEQ ID NO: 3185
  Description of Unknown: uncultivated organism with predicted taxonomy: Phascolarctobacterium succinatutens
  MG18-62 RuvC-III domain

SEQ ID NO: 3236 - protein, 136 aa, Unknown; identical to SEQ ID NO: 3197
  Description of Unknown: uncultivated organism
  MG18-63 RuvC-III domain

SEQ ID NO: 3237 - protein, 136 aa, Unknown
  Description of Unknown: uncultivated organism with predicted taxonomy: Phascolarctobacterium succinatutens
  MG18-64 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3238 - protein, 136 aa, Unknown; identical to SEQ ID NO: 3213
  Description of Unknown: uncultivated organism with predicted taxonomy: Firmicutes
  MG18-65 RuvC-III domain

SEQ ID NO: 3239 - protein, 136 aa, Unknown; identical to SEQ ID NO: 3197
  Description of Unknown: uncultivated organism with predicted taxonomy: Phascolarctobacterium succinatutens
  MG18-66 RuvC-III domain

SEQ ID NO: 3240 - protein, 136 aa, Unknown; identical to SEQ ID NO: 3184
  Description of Unknown: uncultivated organism
  MG18-67 RuvC-III domain

SEQ ID NO: 3241 - protein, 136 aa, Unknown; identical to SEQ ID NO: 3197
  Description of Unknown: uncultivated organism with predicted taxonomy: Phascolarctobacterium succinatutens
  MG18-68 RuvC-III domain

SEQ ID NO: 3242 - protein, 136 aa, Unknown; identical to SEQ ID NO: 3197
  Description of Unknown: uncultivated organism with predicted taxonomy: Phascolarctobacterium succinatutens
  MG18-69 RuvC-III domain

SEQ ID NO: 3243 - protein, 136 aa, Unknown; identical to SEQ ID NO: 3181
  Description of Unknown: uncultivated organism with predicted taxonomy: Negativicutes
  MG18-70 RuvC-III domain

SEQ ID NO: 3244 - protein, 136 aa, Unknown; identical to SEQ ID NO: 3197
  Description of Unknown: uncultivated organism with predicted taxonomy: Phascolarctobacterium succinatutens
  MG18-71 RuvC-III domain

SEQ ID NO: 3245 - protein, 136 aa, Unknown; identical to SEQ ID NO: 3213
  Description of Unknown: uncultivated organism with predicted taxonomy: Phascolarctobacterium succinatutens
  MG18-72 RuvC-III domain

SEQ ID NO: 3246 - protein, 136 aa, Unknown; identical to SEQ ID NO: 3224
  Description of Unknown: uncultivated organism with predicted taxonomy: Phascolarctobacterium
  MG18-73 RuvC-III domain

SEQ ID NO: 3247 - protein, 136 aa, Unknown
  Description of Unknown: uncultivated organism with predicted taxonomy: Phascolarctobacterium succinatutens
  MG18-74 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQAVEGK

SEQ ID NO: 3248 - protein, 136 aa, Unknown; identical to SEQ ID NO: 3179
  Description of Unknown: uncultivated organism with predicted taxonomy: Phascolarctobacterium
  MG18-75 RuvC-III domain

SEQ ID NO: 3249 - protein, 136 aa, Unknown; identical to SEQ ID NO: 3178
  Description of Unknown: uncultivated organism with predicted taxonomy: Phascolarctobacterium succinatutens
  MG18-76 RuvC-III domain

SEQ ID NO: 3250 - protein, 136 aa, Unknown; identical to SEQ ID NO: 3197
  Description of Unknown: uncultivated organism with predicted taxonomy: Phascolarctobacterium
  MG18-78 RuvC-III domain

SEQ ID NO: 3251 - protein, 136 aa, Unknown; identical to SEQ ID NO: 3197
  Description of Unknown: uncultivated organism with predicted taxonomy: Phascolarctobacterium succinatutens
  MG18-79 RuvC-III domain

SEQ ID NO: 3252 - protein, 136 aa, Unknown; identical to SEQ ID NO: 3196
  Description of Unknown: uncultivated organism with predicted taxonomy: Phascolarctobacterium succinatutens
  MG18-80 RuvC-III domain

SEQ ID NO: 3253 - protein, 136 aa, Unknown; identical to SEQ ID NO: 3180
  Description of Unknown: uncultivated organism with predicted taxonomy: Phascolarctobacterium succinatutens
  MG18-81 RuvC-III domain

SEQ ID NO: 3254 - protein, 136 aa, Unknown; identical to SEQ ID NO: 3185
  Description of Unknown: uncultivated organism with predicted taxonomy: Phascolarctobacterium succinatutens
  MG18-82 RuvC-III domain

SEQ ID NO: 3255 - protein, 136 aa, Unknown; identical to SEQ ID NO: 3201
  Description of Unknown: uncultivated organism with predicted taxonomy: Phascolarctobacterium succinatutens
  MG18-83 RuvC-III domain

SEQ ID NO: 3256 - protein, 136 aa, Unknown; identical to SEQ ID NO: 3185
  Description of Unknown: uncultivated organism with predicted taxonomy: Phascolarctobacterium succinatutens
  MG18-84 RuvC-III domain

SEQ ID NO: 3257 - protein, 136 aa, Unknown; identical to SEQ ID NO: 3197
  Description of Unknown: uncultivated organism with predicted taxonomy: Phascolarctobacterium
  MG18-85 RuvC-III domain

SEQ ID NO: 3258 - protein, 136 aa, Unknown; identical to SEQ ID NO: 3182
  Description of Unknown: uncultivated organism with predicted taxonomy: Phascolarctobacterium succinatutens
  MG18-86 RuvC-III domain

SEQ ID NO: 3259 - protein, 136 aa, Unknown; identical to SEQ ID NO: 3197
  Description of Unknown: uncultivated organism with predicted taxonomy: Phascolarctobacterium succinatutens
  MG18-87 RuvC-III domain

SEQ ID NO: 3260 - protein, 136 aa, Unknown; identical to SEQ ID NO: 3179
  Description of Unknown: uncultivated organism with predicted taxonomy: Phascolarctobacterium
  MG18-88 RuvC-III domain

SEQ ID NO: 3261 - protein, 136 aa, Unknown
  Description of Unknown: uncultivated organism with predicted taxonomy: Firmicutes
  MG18-89 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMETVARTMHKNNILFTRQAVEGK

SEQ ID NO: 3262 - protein, 136 aa, Unknown; identical to SEQ ID NO: 3205
  Description of Unknown: uncultivated organism with predicted taxonomy: Phascolarctobacterium
  MG18-90 RuvC-III domain

SEQ ID NO: 3263 - protein, 136 aa, Unknown
  Description of Unknown: uncultivated organism with predicted taxonomy: Phascolarctobacterium succinatutens
  MG18-91 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGADGTMATVARTMHKNNILFTRQPLEGK

SEQ ID NO: 3264 - protein, 136 aa, Unknown; identical to SEQ ID NO: 3197
  Description of Unknown: uncultivated organism with predicted taxonomy: Phascolarctobacterium succinatutens
  MG18-92 RuvC-III domain

SEQ ID NO: 3265 - protein, 136 aa, Unknown
  Description of Unknown: uncultivated organism
  MG18-93 RuvC-III domain
VEMRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGK

SEQ ID NO: 3266 - protein, 136 aa, Unknown; identical to SEQ ID NO: 3197
  Description of Unknown: uncultivated organism with predicted taxonomy: Phascolarctobacterium succinatutens
  MG18-94 RuvC-III domain

SEQ ID NO: 3267 - protein, 136 aa, Unknown; identical to SEQ ID NO: 3213
  Description of Unknown: uncultivated organism
  MG18-95 RuvC-III domain

SEQ ID NO: 3268 - protein, 136 aa, Unknown; identical to SEQ ID NO: 3197
  Description of Unknown: uncultivated organism with predicted taxonomy: Clostridium sp. CAG:964
  MG18-96 RuvC-III domain

SEQ ID NO: 3269 - protein, 136 aa, Unknown; identical to SEQ ID NO: 3197
  Description of Unknown: uncultivated organism with predicted taxonomy: Phascolarctobacterium succinatutens
  MG18-97 RuvC-III domain

SEQ ID NO: 3270 - protein, 136 aa, Unknown
  Description of Unknown: uncultivated organism with predicted taxonomy: Phascolarctobacterium succinatutens
  MG18-98 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEFFYKFNIKRDDDIAWLGGADGTMATVARTMHKNNILFTRQPLEGK

SEQ ID NO: 3271 - protein, 136 aa, Unknown; identical to SEQ ID NO: 3178
  Description of Unknown: uncultivated organism with predicted taxonomy: Firmicutes
  MG18-99 RuvC-III domain

SEQ ID NO: 3272 - protein, 136 aa, Unknown; identical to SEQ ID NO: 3197
  Description of Unknown: uncultivated organism with predicted taxonomy: Phascolarctobacterium succinatutens
  MG18-100 RuvC-III domain

SEQ ID NO: 3273 - protein, 136 aa, Unknown; identical to SEQ ID NO: 3203
  Description of Unknown: uncultivated organism with predicted taxonomy: Firmicutes
  MG18-101 RuvC-III domain

SEQ ID NO: 3274 - protein, 136 aa, Unknown; identical to SEQ ID NO: 3237
  Description of Unknown: uncultivated organism with predicted taxonomy: Firmicutes
  MG18-102 RuvC-III domain

SEQ ID NO: 3275 - protein, 136 aa, Unknown
  Description of Unknown: uncultivated organism with predicted taxonomy: Phascolarctobacterium succinatutens
  MG18-103 RuvC-III domain
VETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQAVEGK

SEQ ID NO: 3276 - protein, 136 aa, Unknown; identical to SEQ ID NO: 3197
  Description of Unknown: uncultivated organism with predicted taxonomy: Phascolarctobacterium
  MG18-104 RuvC-III domain

SEQ ID NO: 3277 - protein, 136 aa, Unknown; identical to SEQ ID NO: 3197
  Description of Unknown: uncultivated organism with predicted taxonomy: Phascolarctobacterium succinatutens
  MG18-105 RuvC-III domain

SEQ ID NO: 3278 - protein, 136 aa, Unknown; identical to SEQ ID NO: 3182
  Description of Unknown: uncultivated organism with predicted taxonomy: Firmicutes
  MG18-106 RuvC-III domain

SEQ ID NO: 3279 - protein, 136 aa, Unknown
  Description of Unknown: uncultivated organism with predicted taxonomy: Phascolarctobacterium succinatutens
  MG18-107 RuvC-III domain
VETRQSTKAVAAILKTAYQNSAVVYVKAGNVSDFRQQFKFVKCREVNDLHHAKDAYLNIVVGNCYHVKFTASPLNFITKNQDNRRYSLKPEIFYKFSIKRDGEIAWLGGEDGTMATVARTMHKNNILFTRQAVEGK

SEQ ID NO: 3280 - protein, 136 aa, Unknown; identical to SEQ ID NO: 3203
  Description of Unknown: uncultivated organism with predicted taxonomy: Ruminococcaceae bacterium
  MG18-108 RuvC-III domain

SEQ ID NO: 3281 - protein, 136 aa, Unknown; identical to SEQ ID NO: 3197
  Description of Unknown: uncultivated organism with predicted taxonomy: Phascolarctobacterium succinatutens
  MG18-109 RuvC-III domain

SEQ ID NO: 3282 - protein, 136 aa, Unknown; identical to SEQ ID NO: 3178
  Description of Unknown: uncultivated organism with predicted taxonomy: Phascolarctobacterium succinatutens
  MG18-111 RuvC-III domain

SEQ ID NO: 3283 - protein, 136 aa, Unknown; identical to SEQ ID NO: 3197
  Description of Unknown: uncultivated organism with predicted taxonomy: Phascolarctobacterium succinatutens
  MG18-112 RuvC-III domain

SEQ ID NO: 3284 - protein, 136 aa, Unknown
  Description of Unknown: uncultivated organism with predicted taxonomy: Clostridiales
  MG18-113 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGK

SEQ ID NO: 3285 - protein, 136 aa, Unknown
  Description of Unknown: uncultivated organism with predicted taxonomy: Phascolarctobacterium
  MG18-114 RuvC-III domain
VETRQSTKAVAAILKTAYQNSEVVYVKAGNVSDFRQQFKFVKCREVNDLHHAKDAYQNIVVGNCYHVKFTANPLNFITKNQDNRRYSLKPEIFYKFSIKRDGEIAWLGGEDGTMATVARTMHKNNILFTRQAVEGK

SEQ ID NO: 3286 - protein, 136 aa, Unknown; identical to SEQ ID NO: 3224
  Description of Unknown: uncultivated organism with predicted taxonomy: Phascolarctobacterium succinatutens
  MG18-115 RuvC-III domain

SEQ ID NO: 3287 - protein, 136 aa, Unknown
  Description of Unknown: uncultivated organism with predicted taxonomy: Phascolarctobacterium succinatutens
  MG18-116 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFNIKRDDDIAWLGGEDGTMATVARTMHKNNILFTRQAVEGK

SEQ ID NO: 3288 - protein, 136 aa, Unknown; identical to SEQ ID NO: 3197
  Description of Unknown: uncultivated organism with predicted taxonomy: Phascolarctobacterium
  MG18-117 RuvC-III domain

SEQ ID NO: 3289 - protein, 136 aa, Unknown; identical to SEQ ID NO: 3197
  Description of Unknown: uncultivated organism with predicted taxonomy: Phascolarctobacterium succinatutens
  MG18-118 RuvC-III domain

SEQ ID NO: 3290 - protein, 136 aa, Unknown; identical to SEQ ID NO: 3197
  Description of Unknown: uncultivated organism with predicted taxonomy: Phascolarctobacterium succinatutens
  MG18-119 RuvC-III domain

SEQ ID NO: 3291 - protein, 136 aa, Unknown; identical to SEQ ID NO: 3197
  Description of Unknown: uncultivated organism with predicted taxonomy: Phascolarctobacterium succinatutens
  MG18-120 RuvC-III domain

SEQ ID NO: 3292 - protein, 136 aa, Unknown; identical to SEQ ID NO: 3224
  Description of Unknown: uncultivated organism with predicted taxonomy: Phascolarctobacterium succinatutens
  MG18-121 RuvC-III domain

SEQ ID NO: 3293 - protein, 136 aa, Unknown; identical to SEQ ID NO: 3203
  Description of Unknown: uncultivated organism with predicted taxonomy: Phascolarctobacterium
  MG18-122 RuvC-III domain

SEQ ID NO: 3294 - protein, 136 aa, Unknown; identical to SEQ ID NO: 3197
  Description of Unknown: uncultivated organism with predicted taxonomy: Phascolarctobacterium succinatutens
  MG18-123 RuvC-III domain

SEQ ID NO: 3295 - protein, 136 aa, Unknown; identical to SEQ ID NO: 3284
  Description of Unknown: uncultivated organism with predicted taxonomy: Phascolarctobacterium succinatutens
  MG18-124 RuvC-III domain

SEQ ID NO: 3296 - protein, 136 aa, Unknown; identical to SEQ ID NO: 3205
  Description of Unknown: uncultivated organism with predicted taxonomy: Phascolarctobacterium
  MG18-125 RuvC-III domain

SEQ ID NO: 3297 - protein, 136 aa, Unknown; identical to SEQ ID NO: 3284
  Description of Unknown: uncultivated organism with predicted taxonomy: Phascolarctobacterium
  MG18-126 RuvC-III domain

SEQ ID NO: 3298 - protein, 136 aa, Unknown; identical to SEQ ID NO: 3185
  Description of Unknown: uncultivated organism with predicted taxonomy: Phascolarctobacterium
  MG18-127 RuvC-III domain

SEQ ID NO: 3299 - protein, 136 aa, Unknown; identical to SEQ ID NO: 3197
  Description of Unknown: uncultivated organism with predicted taxonomy: Phascolarctobacterium
  MG18-128 RuvC-III domain

SEQ ID NO: 3300 - protein, 136 aa, Unknown; identical to SEQ ID NO: 3197
  Description of Unknown: uncultivated organism with predicted taxonomy: Phascolarctobacterium succinatutens
  MG18-129 RuvC-III domain

SEQ ID NO: 3301 - protein, 136 aa, Unknown; identical to SEQ ID NO: 3182
  Description of Unknown: uncultivated organism with predicted taxonomy: Phascolarctobacterium succinatutens
  MG18-130 RuvC-III domain

SEQ ID NO: 3302 - protein, 136 aa, Unknown; identical to SEQ ID NO: 3197
  Description of Unknown: uncultivated organism with predicted taxonomy: Phascolarctobacterium succinatutens
  MG18-131 RuvC-III domain

SEQ ID NO: 3303 - protein, 136 aa, Unknown; identical to SEQ ID NO: 3197
  Description of Unknown: uncultivated organism with predicted taxonomy: Phascolarctobacterium succinatutens
  MG18-132 RuvC-III domain

SEQ ID NO: 3304 - protein, 136 aa, Unknown; identical to SEQ ID NO: 3203
  Description of Unknown: uncultivated organism with predicted taxonomy: Phascolarctobacterium succinatutens
  MG18-133 RuvC-III domain

SEQ ID NO: 3305 - protein, 134 aa, Unknown; identical to SEQ ID NO: 3175
  Description of Unknown: uncultivated organism with predicted taxonomy: Clostridiales
  MG18-135 RuvC-III domain

SEQ ID NO: 3306 - protein, 134 aa, Unknown; identical to SEQ ID NO: 3175
  Description of Unknown: uncultivated organism with predicted taxonomy: Clostridiales
  MG18-136 RuvC-III domain

SEQ ID NO: 3307 - protein, 134 aa, Unknown; identical to SEQ ID NO: 3175
  Description of Unknown: uncultivated organism with predicted taxonomy: Dorea sp. OM02-2LB
  MG18-137 RuvC-III domain

SEQ ID NO: 3308 - protein, 136 aa, Unknown; identical to SEQ ID NO: 3197
  Description of Unknown: uncultivated organism with predicted taxonomy: Phascolarctobacterium
  MG18-138 RuvC-III domain

SEQ ID NO: 3309 - protein, 136 aa, Unknown; identical to SEQ ID NO: 3197
  Description of Unknown: uncultivated organism with predicted taxonomy: Phascolarctobacterium succinatutens
  MG18-139 RuvC-III domain

SEQ ID NO: 3310 - protein, 136 aa, Unknown; identical to SEQ ID NO: 3197
  Description of Unknown: uncultivated organism with predicted taxonomy: Phascolarctobacterium succinatutens
  MG18-140 RuvC-III domain

SEQ ID NO: 3311 - protein, 136 aa, Unknown; identical to SEQ ID NO: 3197
  Description of Unknown: uncultivated organism with predicted taxonomy: Firmicutes
  MG18-141 RuvC-III domain

SEQ ID NO: 3312 - protein, 136 aa, Unknown; identical to SEQ ID NO: 3197
  Description of Unknown: uncultivated organism with predicted taxonomy: Clostridium sp. CAG:964
  MG18-142 RuvC-III domain

SEQ ID NO: 3313 - protein, 134 aa, Unknown; identical to SEQ ID NO: 3175
  Description of Unknown: uncultivated organism with predicted taxonomy: Clostridiales
  MG18-143 RuvC-III domain

SEQ ID NO: 3314 - protein, 134 aa, Unknown; identical to SEQ ID NO: 3175
  Description of Unknown: uncultivated organism with predicted taxonomy: Firmicutes
  MG18-144 RuvC-III domain

SEQ ID NO: 3315 - protein, 134 aa, Unknown; identical to SEQ ID NO: 3175
  Description of Unknown: uncultivated organism with predicted taxonomy: Dorea sp. OM02-2LB
  MG18-145 RuvC-III domain

SEQ ID NO: 3316 - protein, 136 aa, Unknown; identical to SEQ ID NO: 3197
  Description of Unknown: uncultivated organism with predicted taxonomy: Phascolarctobacterium succinatutens
  MG18-146 RuvC-III domain

SEQ ID NO: 3317 - protein, 136 aa, Unknown; identical to SEQ ID NO: 3197
  Description of Unknown: uncultivated organism with predicted taxonomy: Firmicutes
  MG18-147 RuvC-III domain

SEQ ID NO: 3318 - protein, 136 aa, Unknown
  Description of Unknown: uncultivated organism with predicted taxonomy: Lactobacillus oryzae
  MG18-148 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGKDGTITTVTKTMHKNNILFTRQPVEGK

SEQ ID NO: 3319 - protein, 136 aa, Unknown; identical to SEQ ID NO: 3203
  Description of Unknown: uncultivated organism with predicted taxonomy: Phascolarctobacterium
  MG18-149 RuvC-III domain

SEQ ID NO: 3320 - protein, 136 aa, Unknown; identical to SEQ ID NO: 3203
  Description of Unknown: uncultivated organism with predicted taxonomy: Firmicutes
  MG18-150 RuvC-III domain

SEQ ID NO: 3321 - protein, 136 aa, Unknown; identical to SEQ ID NO: 3224
  Description of Unknown: uncultivated organism with predicted taxonomy: Phascolarctobacterium
  MG18-151 RuvC-III domain

SEQ ID NO: 3322 - protein, 136 aa, Unknown; identical to SEQ ID NO: 3203
  Description of Unknown: uncultivated organism with predicted taxonomy: Phascolarctobacterium succinatutens
  MG18-152 RuvC-III domain

SEQ ID NO: 3323 - protein, 136 aa, Unknown; identical to SEQ ID NO: 3197
  Description of Unknown: uncultivated organism with predicted taxonomy: Firmicutes
  MG18-153 RuvC-III domain

SEQ ID NO: 3324 - protein, 136 aa, Unknown; identical to SEQ ID NO: 3197
  Description of Unknown: uncultivated organism with predicted taxonomy: Phascolarctobacterium succinatutens
  MG18-154 RuvC-III domain

SEQ ID NO: 3325 - protein, 136 aa, Unknown; identical to SEQ ID NO: 3182
  Description of Unknown: uncultivated organism with predicted taxonomy: Phascolarctobacterium succinatutens
  MG18-155 RuvC-III domain

SEQ ID NO: 3326 - protein, 136 aa, Unknown; identical to SEQ ID NO: 3197
  Description of Unknown: uncultivated organism with predicted taxonomy: Clostridium sp. CAG:964
  MG18-156 RuvC-III domain

SEQ ID NO: 3327 - protein, 136 aa, Unknown; identical to SEQ ID NO: 3224
  Description of Unknown: uncultivated organism with predicted taxonomy: Ruminococcaceae bacterium
  MG18-157 RuvC-III domain

SEQ ID NO: 3328 - protein, 136 aa, Unknown; identical to SEQ ID NO: 3182
  Description of Unknown: uncultivated organism with predicted taxonomy: Clostridium sp. CAG:964
  MG18-158 RuvC-III domain

SEQ ID NO: 3329 - protein, 136 aa, Unknown; identical to SEQ ID NO: 3205
  Description of Unknown: uncultivated organism with predicted taxonomy: Phascolarctobacterium succinatutens
  MG18-159 RuvC-III domain

SEQ ID NO: 3330 - protein, 137 aa, Unknown
  Description of Unknown: uncultivated organism with predicted taxonomy: Clostridiales
  MG18-160 RuvC-III domain
VETRQSTKAVAEILQQVYPLSKIVYVKAGLVADFRRYMGHVKCREVNDYHHAKDAYLNIVAGNIYHTRFTDNPYNFIKEAKDKDQKYSLKLEKLLTRDIRRGDITAWDTTGNKTRGVVEKVLARNDIRFTRYPYTEK

SEQ ID NO: 3331 - protein, 164 aa, Unknown
  Description of Unknown: uncultivated organism with predicted taxonomy: Firmicutes
  MG21-1 RuvC-III domain
QDTQYLSKVIFRLIENHLQFAETAPGKKHTQPVNGAITAQVRKRLGIEKIREDGDLHHAVDAAVIACITPGMIQKITKYAQNHERFYATAKGYVDIETGEVLTRSEYEAMDDIRFPEPWPGFRSELEARVSEHPQEAIARLKLPHYENSEEIRPIFVSRMPNHK

SEQ ID NO: 3332 - protein, 184 aa, Unknown
  Description of Unknown: uncultivated organism with predicted taxonomy: Roseburia sp. AM23-20
  MG21-3 RuvC-III domain
TDTQYITKAVADILRNYLAFEEDSPFIKKPVRSINGAVTDQVRKRLGLQKHREEGDLHHAMDAAVIAVTTDGYINRISRYTQRREFGKRIGCYKDKQTGEKVEIERQKGQAPLYIDPETGEKLTEQVFDHKYAPTFPAPWKEFTKELKARMAPNADEAIRQLYLPSYGSEEIKPIFVSQMPDRK

SEQ ID NO: 3333 - protein, 184 aa, Unknown; identical to SEQ ID NO: 3332
  Description of Unknown: uncultivated organism with predicted taxonomy: Clostridiales
  MG21-4 RuvC-III domain

SEQ ID NO: 3334 - protein, 184 aa, Unknown; identical to SEQ ID NO: 3332
  Description of Unknown: uncultivated organism
  MG21-5 RuvC-III domain

SEQ ID NO: 3335 - protein, 184 aa, Unknown; identical to SEQ ID NO: 3332
  Description of Unknown: uncultivated organism
  MG21-6 RuvC-III domain

SEQ ID NO: 3336 - protein, 168 aa, Unknown
  Description of Unknown: uncultivated organism with predicted taxonomy: Clostridium sp. CAG:571
  MG21-7 RuvC-III domain
NDTKYICKYMYNLIRNHLEFSDNANFVRKVWTVNGKLTAHIRKRLGIEKVRDGDTHHAVDATVIAITTQNMINRLTRYYQYVDGRYMNNKGEYIDTYTGEIINAKEYEEKYGIYFPEPWPKFRKELDIRTNCKTRERMIECLEAEKIYTYEDYDDVEPIFVSRMPRRK

SEQ ID NO: 3337 - protein, 167 aa, Unknown
  Description of Unknown: uncultivated organism with predicted taxonomy: Clostridiales
  MG21-8 RuvC-III domain
NDTQHITRVVYNYLRNNLKFADSAYAKAPVRAVNGAVTAMLRGRWGIEKMRGNGDLHHCKDAVVIAATSDSMIKDLTKYYQEEEQLFMGKTHFVDPATGEVLTRKEFQQRFAPKFPQPWDRFREELEVRLDPTNPKEALMALNLSTYEFDPEEEIPPVFVSHMPKHT

SEQ ID NO: 3338 - protein, 163 aa, Unknown
  Description of Unknown: uncultivated organism
  MG21-9 RuvC-III domain
TDTQYITKAVADILRNYLAFEEDSPFIKKPVRSINGAVTDQVRKRLGLQKHREEGDLHHAMDAAVIAVTTDGYINRISRYTQRREFGKRIGCYVDLETGEKLTKQAFEQKYEPTFPAPWNKFTKELKARMAPNADEAIRQLYLPSYGSEEIKPIFVSQMPDRK

SEQ ID NO: 3339 - protein, 168 aa, Unknown
  Description of Unknown: uncultivated organism with predicted taxonomy: Clostridiales
  MG21-10 RuvC-III domain
NDTKYICKYMYNLIRNHLEFSDNPNFVRKVWTVNGKLTAHIRKRLGIEKVRDGDTHHAVDATVIAITTQNMINRLTRYYQYVDGRYMNNKGEYIDIYTGEIINAKEYEEKNGIYFPEPWPKFRKELDIRTNCKTRERMIECLEAEKIYTYEDYDDVEPIFVSRMPRRK

(The sequence listing continues in the following parts.)

---

What is claimed is:

1. An engineered nuclease composition comprising:
   (a) an endonuclease comprising a RuvC_III domain comprising a sequence having at least 90% sequence identity to SEQ ID NO2242; and
   (b) an engineered guide ribonucleic acid structure configured to form a complex with said endonuclease comprising:
      (i) a guide ribonucleic acid sequence configured to hybridize to a target deoxyribonucleic acid sequence; and
      (ii) a tracr ribonucleic acid sequence configured to bind to said endonuclease
   wherein said endonuclease comprises a sequence having at least 90% sequence identity to SEQ ID NO 421.

2. The engineered nuclease composition of claim 1, wherein said endonuclease further comprises an HNH domain.

3. The engineered nuclease composition of claim 1, wherein said tracr ribonucleic acid sequence comprises a sequence with at least 80% sequence identity to about 60 to 90 consecutive nucleotides from SEQ ID NO 5495.

4. The engineered nuclease composition of claim 1, wherein said endonuclease is configured to bind to a protospacer adjacent motif (PAM) sequence of SEQ ID NO 5517.

5. The engineered nuclease composition of claim 1, wherein said engineered guide ribonucleic acid structure comprises at least two ribonucleic acid polynucleotides.

6. The engineered nuclease composition of claim 1, wherein said engineered guide ribonucleic acid structure comprises one ribonucleic acid polynucleotide comprising said guide ribonucleic acid sequence and said tracr ribonucleic acid sequence.

7. The engineered nuclease composition of claim 1, wherein said guide ribonucleic acid sequence is complementary to a prokaryotic, bacterial, archaeal, eukaryotic, fungal, plant, mammalian, or human genomic sequence.

8. The engineered nuclease composition of claim 1, wherein said endonuclease comprises one or more nuclear localization sequences (NLSs) proximal to an N or C-terminus of said endonuclease.

9. The engineered nuclease composition of claim 8, wherein said one or more NLSs comprises the sequence of SEQ ID NO 5597.

10. The engineered nuclease composition of claim 1, further comprising
    a single- or double-stranded DNA repair template comprising from 5' to 3': a first homology arm comprising a sequence of at least 20 nucleotides 5' to said target deoxyribonucleic acid sequence, a synthetic DNA sequence of at least 10 nucleotides, and a second homology arm comprising a sequence of at least 20 nucleotides 3' to said target deoxyribonucleic acid sequence.

11. The engineered nuclease composition of claim 1, wherein said engineered nuclease system further comprises a source of $Mg^{2+}$.

12. The engineered nuclease composition of claim 1, wherein said endonuclease and said tracr ribonucleic acid sequence are derived from distinct bacterial species within a same phylum.

13. The engineered nuclease composition of claim 1, wherein said guide RNA structure comprises an RNA sequence predicted to comprise a hairpin consisting of a stem and a loop, wherein the stem comprises at least 10 base-paired ribonucleotides, and an asymmetric bulge within 4 base pairs of the loop.

14. The engineered nuclease composition of claim 1, wherein said tracr ribonucleic acid sequence of said engineered guide ribonucleic acid structure comprises a hairpin comprising at least 8 base-paired ribonucleotides.

15. The engineered nuclease composition of claim 1, wherein said guide ribonucleic acid sequence of said engineered guide ribonucleic acid structure is predicted to comprise a hairpin with an uninterrupted base-paired region comprising at least 8 nucleotides of a guide ribonucleic acid sequence and at least 8 nucleotides of a tracr ribonucleic acid sequence, and wherein said tracr ribonucleic acid sequence comprises, from 5' to 3', a first hairpin and a second hairpin, wherein said first hairpin has a longer stem than said second hairpin.

16. The engineered nuclease composition of claim 1, wherein said endonuclease comprises SEQ ID NO 421 or a conservatively substituted sequence having at least 90% identity thereto.

* * * * *